US007488813B2

(12) United States Patent
Pollock et al.

(10) Patent No.: US 7,488,813 B2
(45) Date of Patent: Feb. 10, 2009

(54) DIAGNOSTIC MARKERS, ESPECIALLY FOR IN VIVO IMAGING, AND ASSAYS AND METHODS OF USE THEREOF

(75) Inventors: Sarah Pollock, Tel-Aviv (IL); Anat Cohen-Dayag, Rehovot (IL); Osnat Sella-Tavor, Gat Rimon (IL); Shirley Sameah-Greenwald, Kfar Saba (IL); Shira Walach, Hod Hasharon (IL); Lily Bazak, Givatayim (IL)

(73) Assignee: Compugen, Ltd., Tel-Aviv (IL)

( * ) Notice: Subject to any disclaimer, the term of this patent is extended or adjusted under 35 U.S.C. 154(b) by 0 days.

(21) Appl. No.: 11/362,260

(22) Filed: Feb. 24, 2006

(65) Prior Publication Data
US 2006/0257896 A1 Nov. 16, 2006

(30) Foreign Application Priority Data
Feb. 24, 2005 (IL) ...................................... 167091

(51) Int. Cl.
C07H 21/02 (2006.01)
C07H 21/04 (2006.01)
(52) U.S. Cl. .................... 536/23.1; 536/24.31; 536/24.3
(58) Field of Classification Search ................. 536/231, 536/24.3, 24.31
See application file for complete search history.

(56) References Cited

U.S. PATENT DOCUMENTS

| | | | |
|---|---|---|---|
| 5,972,616 A | 10/1999 | O'Brien et al. ................. 435/6 |
| 6,331,427 B1 | 12/2001 | Robison ...................... 435/226 |
| 6,586,390 B1 | 7/2003 | Haley et al. ...................... 514/2 |
| 6,607,879 B1 | 8/2003 | Cocks et al. .................... 435/6 |
| 6,625,545 B1 | 9/2003 | Amitai et al. ................. 702/19 |
| 6,635,742 B1 | 10/2003 | Boyle et al. .............. 530/387.1 |
| 6,649,741 B1 | 11/2003 | O'Brien et al. .......... 530/387.1 |
| 6,797,504 B1 * | 9/2004 | Madison et al. ............ 435/226 |
| 6,914,132 B1 | 7/2005 | Wang et al. ................. 536/23.1 |
| 7,022,821 B1 | 4/2006 | O'Brien et al. .......... 530/388.1 |
| 7,030,231 B1 | 4/2006 | Craik et al. ................ 536/23.1 |
| 7,112,430 B2 | 9/2006 | Madison et al. ............. 435/226 |
| 7,171,311 B2 | 1/2007 | Dai et al. ..................... 702/19 |
| 7,172,892 B2 | 2/2007 | Madison et al. ............. 435/226 |
| 7,227,009 B2 | 6/2007 | Craik et al. ................ 536/23.1 |
| 7,291,462 B2 | 11/2007 | O'Brien et al. ................. 435/6 |
| 2002/0026653 A1 | 2/2002 | Allen et al. .................... 800/18 |
| 2002/0052308 A1 | 5/2002 | Rosen et al. .................... 514/1 |
| 2003/0087250 A1 | 5/2003 | Monahan et al. ................. 435/6 |
| 2003/0100746 A1 | 5/2003 | Godbole et al. ............ 536/23.5 |
| 2003/0148295 A1 | 8/2003 | Wan et al. ....................... 435/6 |
| 2003/0181658 A1 | 9/2003 | Madison et al. ............. 530/350 |
| 2003/0224374 A1 | 12/2003 | Dai et al. ........................ 435/6 |
| 2003/0224379 A1 | 12/2003 | Tang et al. ..................... 435/6 |
| 2003/0232350 A1 | 12/2003 | Afar et al. ...................... 435/6 |
| 2003/0235900 A1 | 12/2003 | Madison et al. ............. 435/226 |
| 2004/0001801 A1 | 1/2004 | Madison et al. ............. 424/85.1 |
| 2004/0009481 A1 | 1/2004 | Schlegel et al. ................. 435/6 |
| 2004/0033493 A1 | 2/2004 | Tchernev et al. ............... 435/6 |
| 2004/0037842 A1 | 2/2004 | Meagher et al. .......... 424/185.1 |
| 2004/0053245 A1 | 3/2004 | Tang et al. ..................... 435/6 |
| 2004/0053248 A1 | 3/2004 | Tang et al. ..................... 435/6 |
| 2004/0058340 A1 | 3/2004 | Dai et al. ........................ 435/6 |
| 2004/0086910 A1 | 5/2004 | O'Brien et al. ................. 435/6 |
| 2004/0101876 A1 | 5/2004 | Mintz et al. .................... 435/6 |
| 2004/0132158 A1 | 7/2004 | Bandman et al. ............ 435/226 |
| 2004/0197325 A1 | 10/2004 | Law et al. ................. 424/131.1 |
| 2004/0219521 A1 | 11/2004 | Tang et al. ..................... 435/6 |
| 2005/0059073 A1 | 3/2005 | Tang et al. ..................... 435/6 |
| 2005/0112579 A1 | 5/2005 | Madison et al. ................. 435/6 |
| 2005/0186677 A1 | 8/2005 | Friedrich et al. ............ 435/456 |
| 2005/0192215 A1 | 9/2005 | Ghosh et al. ................... 514/12 |
| 2005/0214831 A1 | 9/2005 | Monahan et al. ............... 435/6 |
| 2006/0099625 A1 | 5/2006 | Craik et al. ..................... 435/6 |
| 2006/0104979 A1 | 5/2006 | Craik et al. ............... 424/146.1 |
| 2006/0183120 A1 | 8/2006 | Teh et al. ........................ 435/6 |
| 2006/0263774 A1 | 11/2006 | Clark et al. ..................... 435/6 |
| 2007/0042945 A1 | 2/2007 | Bodary et al. .................. 514/12 |
| 2007/0093443 A1 | 4/2007 | Madison et al. ............... 514/44 |

FOREIGN PATENT DOCUMENTS

| | | |
|---|---|---|
| WO | WO 01/75067 | 10/2001 |
| WO | WO 01/92581 | 12/2001 |
| WO | WO 02/28999 | 4/2002 |
| WO | WO 02/068579 | 9/2002 |
| WO | WO 02/074979 | * 9/2002 |
| WO | WO 03/042661 | 5/2003 |
| WO | WO 03/048776 | 6/2003 |

(Continued)

OTHER PUBLICATIONS

Diffenbach et al (PCR Methods and Applications 1993, pp. S30-S37).*

(Continued)

Primary Examiner—Sarae Bausch
Assistant Examiner—Steven C Pohnert
(74) Attorney, Agent, or Firm—Winston & Strawn LLP

(57) ABSTRACT

Novel splice variants as diagnostic markers, preferably membrane-bound. The novel variants according to the present invention may optionally be used for diagnosis of Marker-detectable disease as described herein, optionally through immunohistochemistry.

2 Claims, 52 Drawing Sheets

FOREIGN PATENT DOCUMENTS

| | | | | |
|---|---|---|---|---|
| WO | WO 03/057912 | 7/2003 | | |
| WO | WO 03/064641 | 8/2003 | | |
| WO | WO 03/104394 | 12/2003 | | |
| WO | WO 2004/009797 | 1/2004 | | |
| WO | WO 2004/016785 | 2/2004 | | |
| WO | WO 2004/028479 | 4/2004 | | |
| WO | WO2004/028479 | 4/2004 | .................... | 435/6 |
| WO | WO 2004/041170 | 5/2004 | | |
| WO | WO 2004/063355 | 7/2004 | | |
| WO | WO 2004/076614 | 9/2004 | | |
| WO | WO 2004/085677 | 10/2004 | | |
| WO | WO 2004/092365 | 10/2004 | | |
| WO | WO 2005/000087 | 1/2005 | | |
| WO | WO 2005/094332 | 10/2005 | | |
| WO | WO 2005/098041 | 10/2005 | | |
| WO | WO 2006/085684 | 8/2006 | | |

OTHER PUBLICATIONS

Buck et al (Biotechniques, Sep. 1999;27(3):528-36).*
Boguski et al, Nat Genet. Aug. 1993;4(4):332-3.
Cherry, Phys Med Biol, vol. 49, 2004, pp. R13-R48.
Griffin et al. J. Clin. Onc. 1991 9:631-640.
Lauffer, R. B. Magnetic Resonance in Medicine 1991 22:339-342.
Pien et al, Drug Discovery Today, vol. 10, Feb. 2005, pp. 259-266.
Sorek, R., Ast, G. & Graur, D. Alu-containing exons are alternatively spliced. Genome Res 12, 1060-7 (2002).
Sumerdon et al. Nucl. Med. Biol. 1990 17:247-254.

* cited by examiner

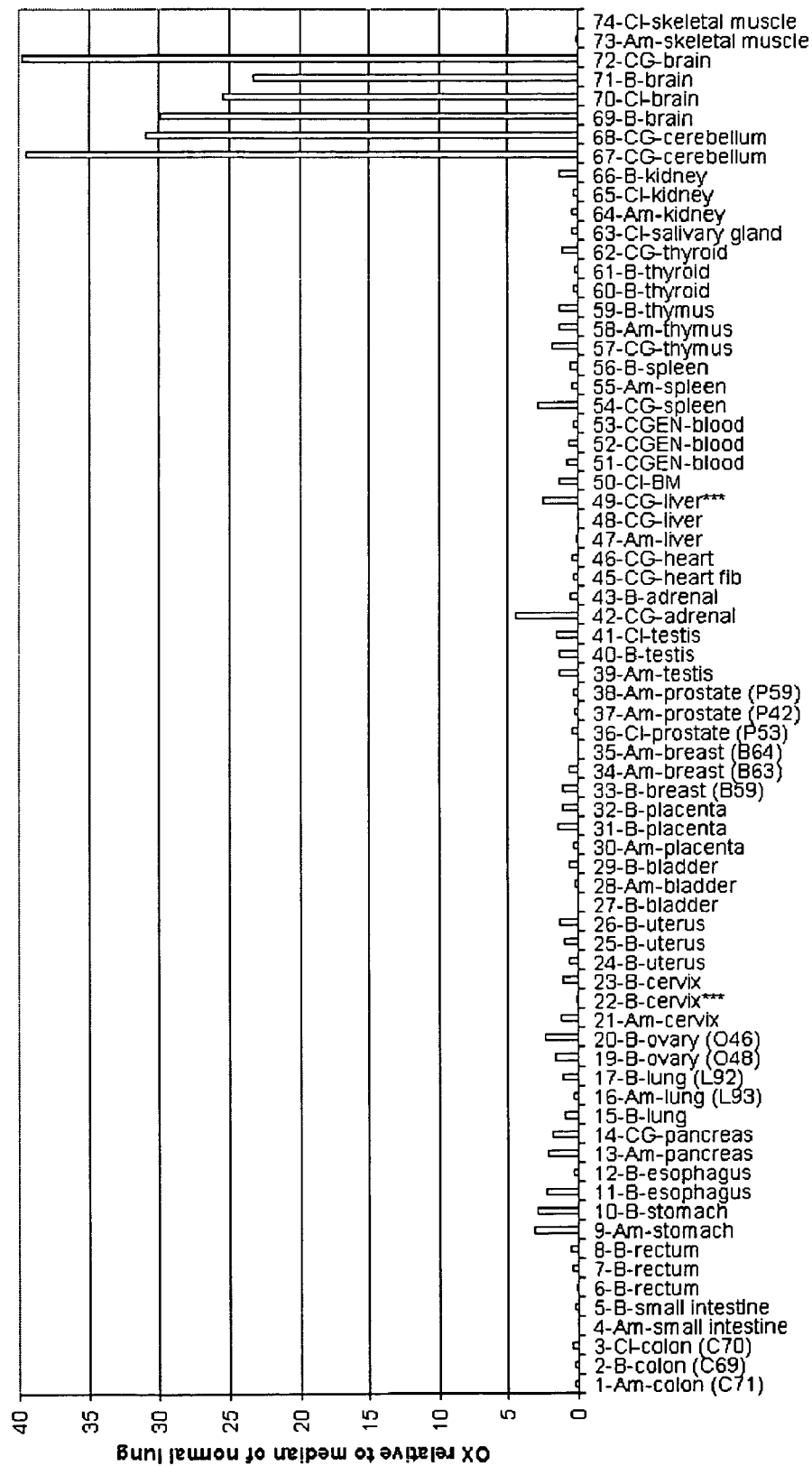

DIAGNOSTIC MARKERS, ESPECIALLY FOR IN VIVO IMAGING, AND ASSAYS AND METHODS OF USE THEREOF

Sequence Listing

The instant application contains a "lengthy" Sequence Listing which has been submitted via CD-R in lieu of a printed paper copy, and is hereby incorporated by reference in its entirety. Said CD-R. recorded on Jul. 12, 2006, are labeled CRF, "Copy 1" and "Copy 2" respectively, and each contains only one identical 924 KB file (COM002.APP).

INCORPORATION-BY-REFERENCE OF MATERIAL SUBMITTED ON A COMPACT DISC

Incorporated by reference is one (1) compact disc containing a Sequence Listing file in computer readable form required by §1.821(e). The file was created Feb. 24, 2006, and is 942 KB (964,608 bytes) in size on disc.

FIELD OF THE INVENTION

The present invention is related to novel nucleotide and protein sequences that may be used as diagnostic markers, particularly for in vivo imaging, and assays and methods of use thereof.

BACKGROUND OF THE INVENTION

Diagnostic markers are important for early diagnosis of many diseases, as well as predicting response to treatment, monitoring treatment and determining prognosis of such diseases.

Diagnostic assays are frequently performed on samples removed from patients. Preferably, these samples are obtained in a minimally invasive manner, for example serum or urine samples. However, such assays can only provide information concerning the state of the marker in the particular sample. They are not able to provide direct information concerning the exact location of metastases and/or the degree of tumor shrinkage, for example.

In vivo imaging technologies provide non-invasive methods for determining the state of a particular disease in the human body. For example, entire portions of the body, or even the entire body, may be viewed as a three dimensional image, thereby providing valuable information concerning morphology and structures in the body. Such technologies may be combined with the detection of particular diagnostic markers, particularly molecular biomarkers, in order to provide information concerning the state of a disease or pathological condition in the human body.

Such imaging is also expanding because of advances in technology. These advances include the development of new contrast agents or labels, such as radiolabels and/or fluorescent labels, which can provide strong signals within the body; and the development of powerful new imaging technology, which can detect and analyze these signals outside the body, with sufficient sensitivity and accuracy to provide useful information. The contrast agent can be visualized in an appropriate imaging system, thereby providing an image of the portion or portions of the body in which the contrast agent is located. The contrast agent may be bound to or associated with an antibody, for example, and/or with a peptide or protein, or an oligonucleotide (for example for detection of gene expression) or complex of these with one or more macromolecules and/or other particulate forms.

The contrast agent may also feature a radioactive atom which is useful in imaging. Suitable radioactive atoms include technetium-99m or iodine-123 for scintigraphic studies. Other readily detectable moieties include, for example, spin labels for magnetic resonance imaging (MRI) such as iodine-123 again, iodine-131, indium-111, fluorine-19, carbon-13, nitrogen-15, oxygen-17, gadolinium, manganese or iron. Such labels are well known in the art and could easily be selected by one of ordinary skill in the art.

Standard imaging techniques include but are not limited to magnetic resonance imaging, computed tomography scanning, PET, SPECT and the like. For diagnostic in vivo imaging, the type of detection instrument available is a major factor in selecting a given contrast agent, such as a given radionuclide and the gene product it targets (mRNA, protein and the like). The radionuclide chosen must have a type of decay that is detectable by a given type of instrument. Another important factor in selecting a radionuclide for in vivo diagnosis is that its half-life be long enough that it is still detectable at the time of maximum uptake by the target tissue, but short enough that deleterious radiation of the host is minimized.

Exemplary imaging techniques include but are not limited to PET or SPECT, which are imaging techniques in which a radionuclide is synthetically or locally administered to a patient. The subsequent uptake of the radiotracer is measured over time and used to obtain information about the targeted tissue and gene product. Because of the high-energy (gamma-ray) emissions of the specific isotopes employed and the sensitivity and sophistication of the instruments used to detect them, the two-dimensional distribution of radioactivity may be inferred from outside of the body.

Among the most commonly used positron-emitting nuclides in PET include but are not limited to carbon-11, nitrogen-13, oxygen-15 and fluorine-18. Isotopes that decay by electron capture and/or gamma-emission are used in SPECT, and include but are not limited to iodine-123 and technetium-99m.

A currently used method for labeling amino acids with technetium-99m is the reduction of pertechnetate ion in the presence of a chelating precursor to form the labile technetium-99m-precursor complex, which, in turn, reacts with the metal binding group of a bifunctionally modified chemotactic peptide to form a technetium-99m-chemotactic peptide conjugate.

Antibodies are frequently used for such in vivo imaging diagnostic methods. The preparation and use of antibodies for in vivo diagnosis is well known in the art. For example, antibody-chelators labeled with Indium-111 have been described for use in the radioimmunoscintographic imaging of carcinoembryonic antigen expressing tumors (Sumerdon et al. Nucl. Med. Biol. 1990 17:247-254). Antibody-chelators have been used to detect new metastases and/or tumor recurrence in patients suspected of having recurrent colorectal cancer (Griffin et al. J. Clin. Onc. 1991 9:631-640). Antibodies with paramagnetic ions as labels for use in magnetic resonance imaging have also been described (Lauffer, R. B. Magnetic Resonance in Medicine 1991 22:339-342). Labeled antibodies which specifically bind a particular molecular biomarker can be injected into patients suspected of having a certain type of cancer, detectable according to that biomarker, for the purpose of diagnosing or staging of the disease status of the patient. The label used will be selected in accordance with the imaging modality to be used as previously described. Localization of the label permits determination of the spread of the cancer. The amount of label within an organ or tissue also allows determination of the presence or absence of cancer in that organ or tissue.

Such techniques may also optionally be performed with labeled oligonucleotides, for example for detection of gene expression through imaging with antisense oligonucleotides (Cherry, Phys Med Biol, vol 29, 2004, pp R13-R48). These methods are already used for in situ hybridization for example with fluorescent molecules or radionuclides as the label. They are currently being developed for use with in vivo imaging. Other methods for detection of gene expression include but are not limited to detection of the activity of a reporter gene.

Another general type of imaging technology is optical imaging, in which fluorescent signals within the subject are detected by an optical device that is external to the subject. These signals may be due to actual fluorescence and/or to bioluminescence. Improvements in the sensitivity of optical detection devices have increased the usefulness of optical imaging for in vivo diagnostic assays (Cherry, Phys Med Biol, vol 29, 2004, pp R13-R48).

The use of in vivo molecular biomarker imaging is increasing, including for clinical trials, for example to more rapidly measure clinical efficacy in trials for new cancer therapies and/or to avoid prolonged treatment with a placebo for those diseases, such as multiple sclerosis, in which such prolonged treatment may be considered to be ethically questionable (Pien et al, DDT, vol 10, February 2005, pp. 259 - 266).

Another example of diagnostic markers are serum markers which are used for diagnosis of many different diseases. Such serum markers typically encompass secreted proteins and/or peptides; however, some serum markers may be released to the blood upon tissue lysis, such as from myocardial infarction (for example Troponin-I). Serum markers can also be used as risk factors for disease (for example base-line levels of CRP, as a predictor of cardiovascular disease), to monitor disease activity and progression (for example, determination of CRP levels to monitor acute phase inflammatory response) and to predict and monitor drug response (for example, as shedded fragments of the protein Erb-B2).

Immunohistochemistry (IHC) is the study of distribution of an antigen of choice in a sample based on specific antibody-antigen binding, typically on tissue slices. The antibody features a label which can be detected, for example as a stain which is detectable under a microscope. The tissue slices are prepared by being fixed. IHC is therefore particularly suitable for antibody-antigen reactions that are not disturbed or destroyed by the process of fixing the tissue slices.

IHC permits determining the localization of binding, and hence mapping of the presence of the antigen within the tissue and even within different compartments in the cell. Such mapping can provide useful diagnostic information, including:
1) the histological type of the tissue sample
2) the presence of specific cell types within the sample
3) information on the physiological and/or pathological state of cells (e.g. which phase of the cell-cycle they are in)
4) the presence of disease related changes within the sample
5) differentiation between different specific disease subtypes where it is already known the tissue is of disease state (for example, the differentiation between different tumor types when it is already known the sample was taken from cancerous tissue).

IHC information is valuable for more than diagnosis. It can also be used to determine prognosis and therapy treatment (as in the case of HER-2 in breast cancer) and monitor disease.

IHC protein markers could be from any cellular location. Most often these markers are membrane proteins but secreted proteins or intracellular proteins (including intranuclear) can be used as an IHC marker too.

IHC has at least two major disadvantages. It is performed on tissue samples and therefore a tissue sample has to be collected from the patient, which most often requires invasive procedures like biopsy associated with pain, discomfort, hospitalization and risk of infection. In addition, the interpretation of the result is observer dependant and therefore subjective. There is no measured value but rather only an estimation (on a scale of 1-4) of how prevalent the antigen on target is.

SUMMARY OF THE INVENTION

The present invention provides a number of different variants of proteins, optionally including membranal proteins, which may optionally be used as diagnostic markers, preferably as markers for in vivo imaging, although alternatively any other use of such markers (diagnostic or therapeutic) is also contemplated within the present invention. The present invention therefore overcomes the many deficiencies of the background art with regard to the need to obtain tissue samples and subjective interpretations of results. As in vivo imaging markers, the variants of the present invention may also provide different and/or better measurement parameters for various diseases and/or pathological conditions. Molecular imaging using these markers could be performed in conjuction with other imaging modalities as CT and MRI which capture body anatomy and overlap it with the in-vivo marker distribution.

The diseases for which such variants may be useful diagnostic markers are described in greater detail below for each of the variants. The variants themselves are described by "cluster" or by gene, as these variants are splice variants of known proteins. Therefore, a "marker-detectable disease" refers to a disease that may be detected by a particular marker, with regard to the description of such diseases below. The markers of the present invention, alone or in combination, show a high degree of differential detection between disease and non-disease states. In-vivo diagnostic using these diagnostic markers could be used for many purposes including but not limited to diagnosis of a disease, monitoring of disease progression, monitoring on response to treatment, decision on treatment choice and differential diagnosis of diseases.

The present invention therefore also relates to diagnostic assays for disease detection optionally and preferably in a biological sample taken from a subject (patient), which is more preferably some type of body fluid or secretion including but not limited to seminal plasma, blood, serum, urine, prostatic fluid, seminal fluid, semen, the external secretions of the skin, respiratory, intestinal, and genitourinary tracts, tears, cerebrospinal fluid, sputum, saliva, milk, peritoneal fluid, pleural fluid, cyst fluid, broncho alveolar lavage, lavage of the reproductive system and/or lavage of any other part of the body or system in the body, and stool or a tissue sample. The term may also optionally encompass samples of in vivo cell culture constituents. The sample can optionally be diluted with a suitable eluant before contacting the sample to an antibody and/or performing any other diagnostic assay.

According to preferred embodiments of the present invention, there is provided, as listed below, optional but preferred embodiments (although provided as a list, this is for the sake of convenience only and is not intended to indicate a closed list or to otherwise be limiting in any way):

An isolated polynucleotide comprising a polynucleotide having a sequence selected from the group consisting of SEQ ID NOs:1-6, 29-33, 85-92, 115-125, 178-192, 238-246, 282-293, 350-361, 631-632.

An isolated polynucleotide comprising a node having a sequence selected from the group consisting of SEQ ID NOs: 7-19, 34-70, 93-107, 126-165, 193-215, 247-269, 294-337, 362-408.

An isolated polypeptide comprising a polypeptide having a sequence selected from the group consisting of SEQ ID NOs: 24-28, 80-84, 111-114, 169-177, 226-237, 276-281, 339-349, 423-429, 633, 641-642.

An isolated chimeric polypeptide encoding for HSI6REC_P1 (SEQ ID NO:24), comprising a first amino acid sequence being at least 90% homologous to amino acids 1-316 of IL6RA_HUMAN (SEQ ID NO:590), which also corresponds to amino acids 1-316 of HSI6REC_P1 (SEQ ID NO:24), a second amino acid sequence being at least 70%, optionally at least 80%, preferably at least 85%, more preferably at least 90% and most preferably at least 95% homologous to a polypeptide having the sequence EMRSHYVTQAGFKLLASWDSPASVSQSAGIT (SEQ ID NO:518) corresponding to amino acids 317-347 of HSI6REC_P1 (SEQ ID NO:24), and a third amino acid sequence being at least 90% homologous to amino acids 317-468 of IL6RA_HUMAN (SEQ ID NO:590), which also corresponds to amino acids 348-499 of HSI6REC_P1 (SEQ ID NO:24), wherein said first amino acid sequence, second amino acid sequence and third amino acid sequence are contiguous and in a sequential order.

An isolated polypeptide encoding for an edge portion of HSI6REC_P1 (SEQ ID NO:24), comprising an amino acid sequence being at least 70%, optionally at least about 80%, preferably at least about 85%, more preferably at least about 90% and most preferably at least about 95% homologous to the sequence EMRSHYVTQAGFKLLASWDSPASVSQSAGIT (SEQ ID NO:518) of HSI6REC_P1 (SEQ ID NO:24).

An isolated chimeric polypeptide encoding for HSI6REC_P1 (SEQ ID NO:24), comprising a first amino acid sequence being at least 90% homologous to amino acids 1-316 of NP_000556 (SEQ ID NO:21), which also corresponds to amino acids 1-316 of HSI6REC_P1 (SEQ ID NO:24), a second amino acid sequence being at least 70%, optionally at least 80%, preferably at least 85%, more preferably at least 90% and most preferably at least 95% homologous to a polypeptide having the sequence EMRSHYVTQAGFKLLASWDSPASVSQSAGIT (SEQ ID NO:518) corresponding to amino acids 317-347 of HSI6REC_P1 (SEQ ID NO:24), and a third amino acid sequence being at least 90% homologous to amino acids 317-468 of NP_000556 (SEQ ID NO:21), which also corresponds to amino acids 348-499 of HSI6REC_P1 (SEQ ID NO:24), wherein said first amino acid sequence, second amino acid sequence and third amino acid sequence are contiguous and in a sequential order.

An isolated polypeptide encoding for an edge portion of HSI6REC_P1 (SEQ ID NO:24), comprising an amino acid sequence being at least 70%, optionally at least about 80%, preferably at least about 85%, more preferably at least about 90% and most preferably at least about 95% homologous to the sequence EMRSHYVTQAGFKLLASWDSPASVSQSAGIT (SEQ ID NO:518) of HSI6REC_P1 (SEQ ID NO:24).

An isolated chimeric polypeptide encoding for HSI6REC_P1 (SEQ ID NO:24), comprising a first amino acid sequence being at least 90% homologous to amino acids 1-316 of P08887-2 (SEQ ID NO:22), which also corresponds to amino acids 1-316 of HSI6REC_P1 (SEQ ID NO:24), a second amino acid sequence being at least 70%, optionally at least 80%, preferably at least 85%, more preferably at least 90% and most preferably at least 95% homologous to a polypeptide having the sequence EMRSHYVTQAGFKLLASWDSPASVSQSAGIT (SEQ ID NO:518) corresponding to amino acids 317-347 of HSI6REC_P1 (SEQ ID NO:24), a third amino acid sequence being at least 90% homologous to amino acids 317-355 of P08887-2 (SEQ ID NO:22), which also corresponds to amino acids 348-386 of HSI6REC_P1 (SEQ ID NO:24), and a fourth amino acid sequence being at least 70%, optionally at least 80%, preferably at least 85%, more preferably at least 90% and most preferably at least 95% homologous to a polypeptide having the sequence VQDSSSVPLPTFLVAGGSLAFGTLLCIAIVLRFKKTWKLRALKEGKTSMHPPYSLGQLVPE RPRPTPVLVPLISPPVSPSSLGSDNTSSHNRPDARDPRSPYDISNTDYFFPR (SEQ ID NO:519) corresponding to amino acids 387-499 of HSI6REC_P1 (SEQ ID NO:24), wherein said first amino acid sequence, second amino acid sequence, third amino acid sequence and fourth amino acid sequence are contiguous and in a sequential order.

An isolated polypeptide encoding for an edge portion of HSI6REC_P1 (SEQ ID NO:24), comprising an amino acid sequence being at least 70%, optionally at least about 80%, preferably at least about 85%, more preferably at least about 90% and most preferably at least about 95% homologous to the sequence EMRSHYVTQAGFKLLASWDSPASVSQSAGIT (SEQ ID NO:518) of HSI6REC_P1 (SEQ ID NO:24).

An isolated polypeptide encoding for an edge portion of HSI6REC_P1 (SEQ ID NO:24), comprising an amino acid sequence being at least 70%, optionally at least about 80%, preferably at least about 85%, more preferably at least about 90% and most preferably at least about 95% homologous to the sequence VQDSSSVPLPTFLVAGGSLAFGTLLCIAIVLRFKKTWKLRALKEGKTSMHPPYSLGQLVPE RPRPTPVLVPLISPPVSPSSLGSDNTSSHNRPDARDPRSPYDISNTDYFFPR (SEQ ID NO:519) of HSI6REC_P1 (SEQ ID NO:24).

An isolated chimeric polypeptide encoding for HSI6REC_P1 (SEQ ID NO:24), comprising a first amino acid sequence being at least 90% homologous to amino acids 1-316 of NP_852004 (SEQ ID NO:23), which also corresponds to amino acids 1-316 of HSI6REC_P1 (SEQ ID NO:24), a second amino acid sequence being at least 70%, optionally at least 80%, preferably at least 85%, more preferably at least 90% and most preferably at least 95% homologous to a polypeptide having the sequence EMRSHYVTQAGFKLLASWDSPASVSQSAGIT (SEQ ID NO:518) corresponding to amino acids 317-347 of HSI6REC_P1 (SEQ ID NO:24), a third amino acid sequence being at least 90% homologous to amino acids 317-355 of NP_852004 (SEQ ID NO:23), which also corresponds to amino acids 348-386 of HSI6REC_P1 (SEQ ID NO:24), and a fourth amino acid sequence being at least 70%, optionally at least 80%, preferably at least 85%, more preferably at least 90% and most preferably at least 95% homologous to a polypeptide having the sequence VQDSSSVPLPTFLVAGGSLAFGTLLCIAIVLRFKKTWKLRALKEGKTSMHPPYSLGQLVPE RPRPTPVLVPLISPPVSPSSLGSDNTSSHNRPDARDPRSPYDISNTDYFFPR corresponding to amino acids 387-499 of HSI6REC_P1 (SEQ ID NO:24), wherein said first amino acid sequence, second amino acid sequence, third amino acid sequence and fourth amino acid sequence are contiguous and in a sequential order.

An isolated polypeptide encoding for an edge portion of HSI6REC_P1 (SEQ ID NO:24), comprising an amino acid sequence being at least 70%, optionally at least about 80%, preferably at least about 85%, more preferably at least about 90% and most preferably at least about 95% homologous to the sequence EMRSHYVTQAGFKLLASWDSPAS-VSQSAGIT (SEQ ID NO:518) of HSI6REC_P1 (SEQ ID NO:24).

An isolated polypeptide encoding for an edge portion of HSI6REC_P1 (SEQ ID NO:24), comprising an amino acid sequence being at least 70%, optionally at least about 80%, preferably at least about 85%, more preferably at least about 90% and most preferably at least about 95% homologous to the sequence VQDSSSVPLPTFLVAGGSLAFGTLLCI-AIVLRFKKTWKLRALKEGKTSMHPPYSLGQLVPE RPRPTPVLVPLISPPVSPSSLGS-DNTSSHNRPDARDPRSPYDISNTDYFFPR (SEQ ID NO:519) of HSI6REC_P1 (SEQ ID NO:24).

An isolated chimeric polypeptide encoding for HSI6REC_P2 (SEQ ID NO:25), comprising a first amino acid sequence being at least 90% homologous to amino acids 1-316 of IL6RA_HUMAN (SEQ ID NO:590), which also corresponds to amino acids 1-316 of HSI6REC_P2 (SEQ ID NO:25), a second amino acid sequence being at least 70%, optionally at least 80%, preferably at least 85%, more preferably at least 90% and most preferably at least 95% homologous to a polypeptide having the sequence GFSPQTIPGGI-WDPAG (SEQ ID NO:520) corresponding to amino acids 317-332 of HSI6REC_P2 (SEQ ID NO:25), and a third amino acid sequence being at least 90% homologous to amino acids 317-468 of IL6RA_HUMAN (SEQ ID NO:590), which also corresponds to amino acids 333-484 of HSI6REC_P2 (SEQ ID NO:25), wherein said first amino acid sequence, second amino acid sequence and third amino acid sequence are contiguous and in a sequential order.

An isolated polypeptide encoding for an edge portion of HSI6REC_P2 (SEQ ID NO:25), comprising an amino acid sequence being at least 70%, optionally at least about 80%, preferably at least about 85%, more preferably at least about 90% and most preferably at least about 95% homologous to the sequence GFSPQTIPGGIWDPAG (SEQ ID NO:520) of HSI6REC_P2 (SEQ ID NO:25).

An isolated chimeric polypeptide encoding for HSI6REC_P2 (SEQ ID NO:25), comprising a first amino acid sequence being at least 90% homologous to amino acids 1-316 of NP_000556 (SEQ ID NO:21), which also corresponds to amino acids 1-316 of HSI6REC_P2 (SEQ ID NO:25), a second amino acid sequence being at least 70%, optionally at least 80%, preferably at least 85%, more preferably at least 90% and most preferably at least 95% homologous to a polypeptide having the sequence GFSPQTIPGGI-WDPAG (SEQ ID NO:520) corresponding to amino acids 317-332 of HSI6REC_P2 (SEQ ID NO:25), and a third amino acid sequence being at least 90% homologous to amino acids 317-468 of NP_000556 (SEQ ID NO:21), which also corresponds to amino acids 333-484 of HSI6REC_P2 (SEQ ID NO:25), wherein said first amino acid sequence, second amino acid sequence and third amino acid sequence are contiguous and in a sequential order.

An isolated polypeptide encoding for an edge portion of HSI6REC_P2 (SEQ ID NO:25), comprising an amino acid sequence being at least 70%, optionally at least about 80%, preferably at least about 85%, more preferably at least about 90% and most preferably at least about 95% homologous to the sequence GFSPQTIPGGIWDPAG (SEQ ID NO:520) of HSI6REC_P2 (SEQ ID NO:25).

An isolated chimeric polypeptide encoding for HSI6REC_P2 (SEQ ID NO:25), comprising. a first amino acid sequence being at least 90% homologous to amino acids 1-316 of P08887-2 (SEQ ID NO:22), which also corresponds to amino acids 1-316 of HSI6REC_P2 (SEQ ID NO:25), a second amino acid sequence being at least 70%, optionally at least 80%, preferably at least 85%, more preferably at least 90% and most preferably at least 95% homologous to a polypeptide having the sequence GFSPQTIPGGIWDPAG (SEQ ID NO:520) corresponding to amino acids 317-332 of HSI6REC_P2 (SEQ ID NO:25), a third amino acid sequence being at least 90% homologous to amino acids 317-355 of P08887-2 (SEQ ID NO:22), which also corresponds to amino acids 333-371 of HSI6REC_P2 (SEQ ID NO:25), and a fourth amino acid sequence being at least 70%, optionally at least 80%, preferably at least 85%, more preferably at least 90% and most preferably at least 95% homologous to a polypeptide having the sequence VQDSSSVPLPT-FLVAGGSLAFGTLLCIAIVLRFKKTWKL-RALKEGKTSMHPPYSLGQLVPE RPRPTPVLVPLISP-PVSPSSLGSDNTSSHNRPDARDPRSPYDISNTDYFFPR (SEQ ID NO:519) corresponding to amino acids 372-484 of HSI6REC_P2 (SEQ ID NO:25), wherein said first amino acid sequence, second amino acid sequence, third amino acid sequence and fourth amino acid sequence are contiguous and in a sequential order.

An isolated polypeptide encoding for an edge portion of HSI6REC_P2 (SEQ ID NO:25), comprising an amino acid sequence being at least 70%, optionally at least about 80%, preferably at least about 85%, more preferably at least about 90% and most preferably at least about 95% homologous to the sequence GFSPQTIPGGIWDPAG (SEQ ID NO:520) of HSI6REC_P2 (SEQ ID NO:25).

An isolated polypeptide encoding for an edge portion of HSI6REC_P2 (SEQ ID NO:25), comprising an amino acid sequence being at least 70%, optionally at least about 80%, preferably at least about 85%, more preferably at least about 90% and most preferably at least about 95% homologous to the sequence VQDSSSVPLPTFLVAGGSLAFGTLLCI-AIVLRFKKTWKLRALKEGKTSMHPPYSLGQLVPE RPRPTPVLVPLISPPVSPSSLGS-DNTSSHNRPDARDPRSPYDISNTDYFFPR (SEQ ID NO:519) of HSI6REC_P2 (SEQ ID NO:25).

An isolated chimeric polypeptide encoding for HSI6REC_P2 (SEQ ID NO:25), comprising a first amino acid sequence being at least 90% homologous to amino acids 1-316 of NP_852004 (SEQ ID NO:23), which also corresponds to amino acids 1-316 of HSI6REC_P2 (SEQ ID NO:25), a second amino acid sequence being at least 70%, optionally at least 80%, preferably at least 85%, more preferably at least 90% and most preferably at least 95% homologous to a polypeptide having the sequence GFSPQTIPGGI-WDPAG (SEQ ID NO:520) corresponding to amino acids 317-332 of HSI6REC_P2 (SEQ ID NO:25), a third amino acid sequence being at least 90% homologous to amino acids 317-355 of NP_852004 (SEQ ID NO:23), which also corresponds to amino acids 333-371 of HSI6REC_P2 (SEQ ID NO:25), and a fourth amino acid sequence being at least 70%, optionally at least 80%, preferably at least 85%, more preferably at least 90% and most preferably at least 95% homologous to a polypeptide having the sequence VQDSSSVPLPT-FLVAGGSLAFGTLLCIAIVLRFKKTWKLRALKEGKTS MHPPYSLGQLVPE RPRPTPVLVPLISPPVSPSSLGS-DNTSSHNRPDARDPRSPYDISNTDYFFPR (SEQ ID NO:519) corresponding to amino acids 372-484 of HSI6REC_P2 (SEQ ID NO:25), wherein said first amino acid sequence, second amino acid sequence, third amino acid sequence and fourth amino acid sequence are contiguous and in a sequential order.

An isolated polypeptide encoding for an edge portion of HSI6REC_P2 (SEQ ID NO:25), comprising an amino acid sequence being at least 70%, optionally at least about 80%, preferably at least about 85%, more preferably at least about 90% and most preferably at least about 95% homologous to the sequence GFSPQTIPGGIWDPAG (SEQ ID NO:520) of HSI6REC_P2 (SEQ ID NO:25).

An isolated polypeptide encoding for an edge portion of HSI6REC_P2 (SEQ ID NO:25), comprising an amino acid sequence being at least 70%, optionally at least about 80%, preferably at least about 85%, more preferably at least about 90% and most preferably at least about 95% homologous to the sequence VQDSSSVPLPTFLVAGGSLAFGTLLCI-AIVLRFKKTWKLRALKEGKTSMHPPYSLGQLVPE RPRPTPVLVPLISPPVSPSSLGS-DNTSSHNRPDARDPRSPYDISNTDYFFPR (SEQ ID NO:519) of HSI6REC_P2 (SEQ ID NO:25).

An isolated chimeric polypeptide encoding for HSI6REC_P4 (SEQ ID NO:26), comprising a first amino acid sequence being at least 90% homologous to amino acids 1-269 of IL6RA_HUMAN (SEQ ID NO:590), which also corresponds to amino acids 1-269 of HSI6REC_P4 (SEQ ID NO:26), and a second amino acid sequence being at least 70%, optionally at least 80%, preferably at least 85%, more preferably at least 90% and most preferably at least 95% homologous to a polypeptide having the sequence NPGV-LQLRTRCPPPCRHLLLIKTMIIF-SSEILQMRQASQCKILLQYHCPHSWLLEGAWPSER SSALPLF (SEQ ID NO:522) corresponding to amino acids 270-338 of HSI6REC_P4 (SEQ ID NO:26), wherein said first amino acid sequence and second amino acid sequence are contiguous and in a sequential order.

An isolated polypeptide encoding for an edge portion of HSI6REC_P4 (SEQ ID NO:26), comprising an amino acid sequence being at least 70%, optionally at least about 80%, preferably at least about 85%, more preferably at least about 90% and most preferably at least about 95% homologous to the sequence NPGVLQLRTRCPPPCRHLLLIKTMIIF-SSEILQMRQASQCKILLQYHCPHSWLLEGAWPSER SSALPLF (SEQ ID NO:522) of HSI6REC_P4 (SEQ ID NO:26).

An isolated chimeric polypeptide encoding for HSI6REC_P4 (SEQ ID NO:26), comprising a first amino acid sequence being at least 90% homologous to amino acids 1-269 of P08887-2 (SEQ ID NO:22), which also corresponds to amino acids 1-269 of HSI6REC_P4 (SEQ ID NO:26), and a second amino acid sequence being at least 70%, optionally at least 80%, preferably at least 85%, more preferably at least 90% and most preferably at least 95% homologous to a polypeptide having the sequence NPGVLQLRTRCPP-PCRHLLLIKTMIIFSSEILQMRQASQCK-ILLQYHCPHSWLLEGAWPSER SSALPLF (SEQ ID NO:522) corresponding to amino acids 270-338 of HSI6REC_P4 (SEQ ID NO:26), wherein said first amino acid sequence and second amino acid sequence are contiguous and in a sequential order.

An isolated polypeptide encoding for an edge portion of HSI6REC_P4 (SEQ ID NO:26), comprising an amino acid sequence being at least 70%, optionally at least about 80%, preferably at least about 85%, more preferably at least about 90% and most preferably at least about 95% homologous to the sequence NPGVLQLRTRCPPPCRHLLLIKTMIIF-SSEILQMRQASQCKILLQYHCPHSWLLEGAWPSER SSALPLF (SEQ ID NO:522) of HSI6REC_P4 (SEQ ID NO:26).

An isolated chimeric polypeptide encoding for HSI6REC_P4 (SEQ ID NO:26), comprising a first amino acid sequence being at least 90% homologous to amino acids 1-269 of NP_852004 (SEQ ID NO:23), which also corresponds to amino acids 1-269 of HSI6REC_P4 (SEQ ID NO:26), and a second amino acid sequence being at least 70%, optionally at least 80%, preferably at least 85%, more preferably at least 90% and most preferably at least 95% homologous to a polypeptide having the sequence NPGV-LQLRTRCPPPCRHLLLIKTMIIF-SSEILQMRQASQCKILLQYHCPHSWLLEGAWPSER SSALPLF (SEQ ID NO:522) corresponding to amino acids 270-338 of HSI6REC_P4 (SEQ ID NO:26), wherein said first amino acid sequence and second amino acid sequence are contiguous and in a sequential order.

An isolated polypeptide encoding for an edge portion of HSI6REC_P4 (SEQ ID NO:26), comprising an amino acid sequence being at least 70%, optionally at least about 80%, preferably at least about 85%, more preferably at least about 90% and most preferably at least about 95% homologous to the sequence NPGVLQLRTRCPPPCRHLLLIKTMIIF-SSEILQMRQASQCKILLQYHCPHSWLLEGAWPSER SSALPLF (SEQ ID NO:522) of HSI6REC_P4 (SEQ ID NO:26).

An isolated chimeric polypeptide encoding for HSI6REC_P4 (SEQ ID NO:26), comprising a first amino acid sequence being at least 90% homologous to amino acids 1-269 of NP_000556 (SEQ ID NO:21), which also corresponds to amino acids 1-269 of HSI6REC_P4 (SEQ ID NO:26), and a second amino acid sequence being at least 70%, optionally at least 80%, preferably at least 85%, more preferably at least 90% and most preferably at least 95% homologous to a polypeptide having the sequence NPGV-LQLRTRCPPPCRHLLLIKTMIIF-SSEILQMRQASQCKILLQYHCPHSWLLEGAWPSER SSALPLF (SEQ ID NO:522) corresponding to amino acids 270-338 of HSI6REC_P4 (SEQ ID NO:26), wherein said first amino acid sequence and second amino acid sequence are contiguous and in a sequential order.

An isolated polypeptide encoding for an edge portion of HSI6REC_P4 (SEQ ID NO:26), comprising an amino acid sequence being at least 70%, optionally at least about 80%, preferably at least about 85%, more preferably at least about 90% and most preferably at least about 95% homologous to the sequence NPGVLQLRTRCPPPCRHLLLIKTMIIF-SSEILQMRQASQCKILLQYHCPHSWLLEGAWPSER SSALPLF (SEQ ID NO:522) of HSI6REC_P4 (SEQ ID NO:26).

An isolated chimeric polypeptide encoding for HSI6REC_P5 (SEQ ID NO:27), comprising a first amino acid sequence being at least 90% homologous to amino acids 1-332 of IL6RA_HUMAN (SEQ ID NO:590), which also corresponds to amino acids 1-332 of HSI6REC_P5 (SEQ ID NO:27), and a second amino acid sequence being at least 70%, optionally at least 80%, preferably at least 85%, more preferably at least 90% and most preferably at least 95% homologous to a polypeptide having the sequence VQED-VEAAGSEGRQDKHASAVLFGAAGPGE-ASTHPSACSSHLPTGVPQQPGV (SEQ ID NO:523) corresponding to amino acids 333-384 of HSI6REC_P5 (SEQ ID NO:27), wherein said first amino acid sequence and second amino acid sequence are contiguous and in a sequential order.

An isolated polypeptide encoding for an edge portion of HSI6REC_P5 (SEQ ID NO:27), comprising an amino acid sequence being at least 70%, optionally at least about 80%, preferably at least about 85%, more preferably at least about 90% and most preferably at least about 95% homologous to the sequence VQEDVEAAGSEGRQDKHASAVLFGAAG-PGEASTHPSACSSHLPTGVPQQPGV (SEQ ID NO:523) of HSI6REC_P5 (SEQ ID NO:27).

An isolated chimeric polypeptide encoding for HSI6REC_P5 (SEQ ID NO:27), comprising a first amino acid sequence being at least 90% homologous to amino acids 1-332 of P08887-2 (SEQ ID NO:22), which also corresponds to amino acids 1-332 of HSI6REC_P5 (SEQ ID NO:27), and a second amino acid sequence being at least 70%, optionally at least 80%, preferably at least 85%, more preferably at least 90% and most preferably at least 95% homologous to a polypeptide having the sequence VQEDVEAAGSEGRQDKHASAVLFGAAGPGEASTHPSACSSHLPTGVPQQPGV (SEQ ID NO:523) corresponding to amino acids 333-384 of HSI6REC_P5 (SEQ ID NO:27), wherein said first amino acid sequence and second amino acid sequence are contiguous and in a sequential order.

An isolated polypeptide encoding for an edge portion of HSI6REC_P5 (SEQ ID NO:27), comprising an amino acid sequence being at least 70%, optionally at least about 80%, preferably at least about 85%, more preferably at least about 90% and most preferably at least about 95% homologous to the sequence VQEDVEAAGSEGRQDKHASAVLFGAAGPGEASTHPSACSSHLPTGVPQQPGV (SEQ ID NO:523) of HSI6REC_P5 (SEQ ID NO:27).

An isolated chimeric polypeptide encoding for HSI6REC_P5 (SEQ ID NO:27), comprising a first amino acid sequence being at least 90% homologous to amino acids 1-332 of NP_852004 (SEQ ID NO:23), which also corresponds to amino acids 1-332 of HSI6REC_P5 (SEQ ID NO:27), and a second amino acid sequence being at least 70%, optionally at least 80%, preferably at least 85%, more preferably at least 90% and most preferably at least 95% homologous to a polypeptide having the sequence VQEDVEAAGSEGRQDKHASAVLFGAAGPGEASTHPSACSSHLPTGVPQQPGV (SEQ ID NO:523) corresponding to amino acids 333-384 of HSI6REC_P5 (SEQ ID NO:27), wherein said first amino acid sequence and second amino acid sequence are contiguous and in a sequential order.

An isolated polypeptide encoding for an edge portion of HSI6REC_P5 (SEQ ID NO:27), comprising an amino acid sequence being at least 70%, optionally at least about 80%, preferably at least about 85%, more preferably at least about 90% and most preferably at least about 95% homologous to the sequence VQEDVEAAGSEGRQDKHASAVLFGAAGPGEASTHPSACSSHLPTGVPQQPGV (SEQ ID NO:523) of HSI6REC_P5 (SEQ ID NO:27).

An isolated chimeric polypeptide encoding for HSI6REC_P5 (SEQ ID NO:27), comprising a first amino acid sequence being at least 90% homologous to amino acids 1-332 of NP_000556 (SEQ ID NO:21), which also corresponds to amino acids 1-332 of HSI6REC_P5 (SEQ ID NO:27), and a second amino acid sequence being at least 70%, optionally at least 80%, preferably at least 85%, more preferably at least 90% and most preferably at least 95% homologous to a polypeptide having the sequence VQEDVEAAGSEGRQDKHASAVLFGAAGPGEASTHPSACSSHLPTGVPQQPGV (SEQ ID NO:523) corresponding to amino acids 333-384 of HSI6REC_P5 (SEQ ID NO:27), wherein said first amino acid sequence and second amino acid sequence are contiguous and in a sequential order.

An isolated polypeptide encoding for an edge portion of HSI6REC_P5 (SEQ ID NO:27), comprising an amino acid sequence being at least 70%, optionally at least about 80%, preferably at least about 85%, more preferably at least about 90% and most preferably at least 95% homologous to the sequence VQEDVEAAGSEGRQDKHASAVLFGAAGPGEASTHPSACSSHLPTGVPQQPGV (SEQ ID NO:523) of HSI6REC_P5 (SEQ ID NO:27).

An isolated chimeric polypeptide encoding for HSI6REC_P6 (SEQ ID NO:28), comprising a first amino acid sequence being at least 90% homologous to amino acids 1-316 of IL6RA_HUMAN (SEQ ID NO:590), which also corresponds to amino acids 1-316 of HSI6REC_P6 (SEQ ID NO:28), and a second amino acid sequence being at least 70%, optionally at least 80%, preferably at least 85%, more preferably at least 90% and most preferably at least 95% homologous to a polypeptide having the sequence DRLSPRCPGWSTAVQSQLTATSASWVQAILPPQPPK (SEQ ID NO:524) corresponding to amino acids 317-352 of HSI6REC_P6 (SEQ ID NO:28), wherein said first amino acid sequence and second amino acid sequence are contiguous and in a sequential order.

An isolated polypeptide encoding for an edge portion of HSI6REC_P6 (SEQ ID NO:28), comprising an amino acid sequence being at least 70%, optionally at least about 80%, preferably at least about 85%, more preferably at least about 90% and most preferably at least about 95% homologous to the sequence DRLSPRCPGWSTAVQSQLTATSASWVQAILPPQPPK (SEQ ID NO:524) of HSI6REC_P6 (SEQ ID NO:28).

An isolated chimeric polypeptide encoding for HSI6REC_P6 (SEQ ID NO:28), comprising a first amino acid sequence being at least 90% homologous to amino acids 1-316 of P08887-2 (SEQ ID NO:22), which also corresponds to amino acids 1-316 of HSI6REC_P6 (SEQ ID NO:28), and a second amino acid sequence being at least 70%, optionally at least 80%, preferably at least 85%, more preferably at least 90% and most preferably at least 95% homologous to a polypeptide having the sequence DRLSPRCPGWSTAVQSQLTATSASWVQAILPPQPPK (SEQ ID NO:524) corresponding to amino acids 317-352 of HSI6REC_P6 (SEQ ID NO:28), wherein said first amino acid sequence and second amino acid sequence are contiguous and in a sequential order.

An isolated polypeptide encoding for an edge portion of HSI6REC_P6 (SEQ ID NO:28), comprising an amino acid sequence being at least 70%, optionally at least about 80%, preferably at least about 85%, more preferably at least about 90% and most preferably at least about 95% homologous to the sequence DRLSPRCPGWSTAVQSQLTATSASWVQAILPPQPPK (SEQ ID NO:524) of HSI6REC_P6 (SEQ ID NO:28).

An isolated chimeric polypeptide encoding for HSI6REC_P6 (SEQ ID NO:28), comprising a first amino acid sequence being at least 90% homologous to amino acids 1-316 of NP_852004 (SEQ ID NO:23), which also corresponds to amino acids 1-316 of HSI6REC_P6 (SEQ ID NO:28), and a second amino acid sequence being at least 70%, optionally at least 80%, preferably at least 85%, more preferably at least 90% and most preferably at least 95% homologous to a polypeptide having the sequence DRLSPRCPGWSTAVQSQLTATSASWVQAILPPQPPK (SEQ ID NO:524) corresponding to amino acids 317-352 of HSI6REC_P6 (SEQ ID NO:28), wherein said first amino acid sequence and second amino acid sequence are contiguous and in a sequential order.

B. An isolated polypeptide encoding for an edge portion of HSI6REC_P6 (SEQ ID NO:28), comprising an amino acid sequence being at least 70%, optionally at least about 80%, preferably at least about 85%, more preferably at least about 90%-and most preferably at least about 95% homologous to the sequence DRLSPRCPGWSTAVQSQLTATSASWVQAILPPQPPK (SEQ ID NO:524) of HSI6REC_P6 (SEQ ID NO:28).

An isolated chimeric polypeptide encoding for HSI6REC_P6 (SEQ ID NO:28), comprising a first amino acid sequence being at least 90% homologous to amino acids 1-316 of NP_000556 (SEQ ID NO:21), which also corresponds to amino acids 1-316 of HSI6REC_P6 (SEQ ID NO:28), and a second amino acid sequence being at least 70%, optionally at least 80%, preferably at least 85%, more preferably at least 90% and most preferably at least 95% homologous to a polypeptide having the sequence DRLSPRCPGWSTAVQSQLTATSASWVQAILPPQPPK (SEQ ID NO:524) corresponding to amino acids 317-352 of HSI6REC_P6 (SEQ ID NO:28), wherein said first amino acid sequence and second amino acid sequence are contiguous and in a sequential order.

An isolated polypeptide encoding for an edge portion of HSI6REC_P6 (SEQ ID NO:28), comprising an amino acid sequence being at least 70%, optionally at least about 80%, preferably at least about 85%, more preferably at least about 90% and most preferably at least about 95% homologous to the sequence DRLSPRCPGWSTAVQSQLTATSASWVQAILPPQPPK (SEQ ID NO:524) of HSI6REC_P6 (SEQ ID NO:28).

An isolated chimeric polypeptide encoding for HSU40434_P7 (SEQ ID NO:80), comprising a first amino acid sequence being at least 90% homologous to amino acids 1-308 of Q96GR6_HUMAN (SEQ ID NO:72), which also corresponds to amino acids 1-308 of HSU40434_P7 (SEQ ID NO:80), a bridging amino acid R corresponding to amino acid 309 of HSU40434_P7 (SEQ ID NO:80), and a second amino acid sequence being at least 90% homologous to amino acids 310-458 of Q96GR6_HUMAN (SEQ ID NO:72), which also corresponds to amino acids 310-458 of HSU40434_P7 (SEQ ID NO:80), wherein said first amino acid sequence, bridging amino acid and second amino acid sequence are contiguous and in a sequential order.

An isolated chimeric polypeptide encoding for HSU40434_P7 (SEQ ID NO:80), comprising a first amino acid sequence being at least 90% homologous to amino acids 1-43 of Q9BTR2_HUMAN (SEQ ID NO:75), which also corresponds to amino acids 1-43 of HSU40434_P7 (SEQ ID NO:80), a bridging amino acid E corresponding to amino acids 44 of HSU40434_P7 (SEQ ID NO:80), and a second amino acid sequence being at least 90% homologous to amino acids 44-457 of Q9BTR2_HUMAN (SEQ ID NO:75), which also corresponds to amino acids 45-458 of HSU40434_P7 (SEQ ID NO:80), wherein said first amino acid sequence, bridging amino acid and second amino acid sequence are contiguous and in a sequential order.

An isolated chimeric polypeptide encoding for HSU40434_P7 (SEQ ID NO:80), comprising a first amino acid sequence being at least 90% homologous to to amino acids 1-410 of NP_037536 (SEQ ID NO:76), which also corresponds to amino acids 1-410 of HSU40434_P7 (SEQ ID NO:80), and a second amino acid sequence being at least 90% homologous to amino acids 419-466 of NP_037536 (SEQ ID NO:76), which also corresponds to amino acids 411-458 of HSU40434_P7 (SEQ ID NO:80), wherein said first amino acid sequence and second amino acid sequence are contiguous and in a sequential order.

An isolated chimeric polypeptide encoding for an edge portion of HSU40434_P7 (SEQ ID NO:80), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 41 0-x to 410; and ending at any of amino acid numbers 411+((n−2)−x), in which x varies from 0 to n−2.

An isolated chimeric polypeptide encoding for HSU40434_P7 (SEQ ID NO:80), comprising a first amino acid sequence being at least 90% homologous to amino acids 1-410 of Q9BR17_HUMAN (SEQ ID NO:73), which also corresponds to amino acids 1-410 of HSU40434_P7 (SEQ ID NO:80), and a second amino acid sequence being at least 90% homologous to amino acids 419-466 of Q9BR17_HUMAN (SEQ ID NO:73), which also corresponds to amino acids 411-458 of HSU40434_P7 (SEQ ID NO:80), wherein said first amino acid sequence and second amino acid sequence are contiguous and in a sequential order.

An isolated chimeric polypeptide encoding for an edge portion of HSU40434_P7 (SEQ ID NO:80), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 410-x to 410; and ending at any of amino acid numbers 411+((n−2)−x), in which x varies from 0 to n−2.

An isolated chimeric polypeptide encoding for HSU40434_P11 (SEQ ID NO:81), comprising a first amino acid sequence being at least 90% homologous to amino acids 1-208 of NP_005814 (SEQ ID NO:78), which also corresponds to amino acids 1-208 of HSU40434_P11 (SEQ ID NO:81), and a second amino acid sequence being at least 90% homologous to amino acids 266-622 of NP_005814 (SEQ ID NO:78), which also corresponds to amino acids 209-565 of HSU40434_P11 (SEQ ID NO:81), wherein said first amino acid sequence and second amino acid sequence are contiguous and in a sequential order.

An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n−2)−x), in which x varies from 0 to n−2.

An isolated chimeric polypeptide encoding for HSU40434_P11 (SEQ ID NO:81), comprising a first amino acid sequence being at least 90% homologous to amino acids 1-208 of Q96KJ5_HUMAN (SEQ ID NO:79), which also corresponds to amino acids 1-208 of HSU40434_P11 (SEQ ID NO:81), and a second amino acid sequence being at least 90% homologous to amino acids 266-622 of Q96KJ5_HUMAN (SEQ ID NO:79), which also corresponds to amino acids 209-565 of HSU40434_P11 (SEQ ID NO:81), wherein said first amino acid sequence and second amino acid sequence are contiguous and in a sequential order.

An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n−2)−x), in which x varies from 0 to n−2.

An isolated chimeric polypeptide encoding for HSU40434_P11 (SEQ ID NO:81), comprising a first amino acid sequence being at least 90% homologous to amino acids 1-208 of Q96GR6_HUMAN (SEQ ID NO:72), which also corresponds to amino acids 1-208 of HSU40434_P11 (SEQ ID NO:81), a second amino acid sequence being at least 90% homologous to amino acids 266-308 of Q96GR6_HUMAN (SEQ ID NO:72), which also corresponds to amino acids 209-251 of HSU40434_P11 (SEQ ID NO:81), a bridging amino acid R corresponding to amino acid 252 of HSU40434_P11 (SEQ ID NO:81), and a third amino acid sequence being at least 90% homologous to amino acids 310-622 of Q96GR6_HUMAN (SEQ ID NO:72), which also corresponds to amino acids 253-565 of HSU40434_P1 (SEQ ID NO:81), wherein said first amino acid sequence, second amino acid sequence, bridging amino acid and third amino acid sequence are contiguous and in a sequential order.

An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n−2)−x), in which x varies from 0 to n−2.

An isolated chimeric polypeptide encoding for HSU40434_P11 (SEQ ID NO:81), comprising a first amino acid sequence being at least 90% homologous to amino acids 1-208 of Q14859_HUMAN (SEQ ID NO:74), which also corresponds to amino acids 1-208 of HSU40434_P11 (SEQ ID NO:81), a second amino acid sequence being at least 90% homologous to amino acids 266-592 of Q14859_HUMAN (SEQ ID NO:74), which also corresponds to amino acids 209-535 of HSU40434_P11 (SEQ ID NO:81), a bridging amino acid M corresponding to amino acid 536 of HSU40434_P11 (SEQ ID NO:81), and a third amino acid sequence being at least 90% homologous to amino acids 594-622 of Q14859_HUMAN (SEQ ID NO:74), which also corresponds to amino acids 537-565 of HSU40434_P11 (SEQ ID NO:81), wherein said first amino acid sequence, second amino acid sequence, bridging amino acid and third amino acid sequence are contiguous and in a sequential order.

An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n−2)−x), in which x varies from 0 to n−2.

An isolated chimeric polypeptide encoding for HSU40434_P11 (SEQ ID NO:81), comprising a first amino acid sequence being at least 90% homologous to amino acids 1-43 of Q9BTR2_HUMAN (SEQ ID NO:75), which also corresponds to amino acids 1-43 of HSU40434_P11 (SEQ ID NO:81), first bridging amino acid E corresponding to amino acids 44 of HSU40434_P11 (SEQ ID NO:81), a second amino acid sequence being at least 90% homologous to amino acids 44-207 of Q9BTR2_HUMAN (SEQ ID NO:75), which also corresponds to amino acids 45-208 of HSU40434_P11 (SEQ ID NO:81), a third amino acid sequence being at least 90% homologous to amino acids 265-591 of Q9BTR2_HUMAN (SEQ ID NO:75), which also corresponds to amino acids 209-535 of HSU40434_P11 (SEQ ID NO:81), second bridging amino acid M corresponding to amino acid 536 of HSU40434_P11 (SEQ ID NO:81), and a fourth amino acid sequence being at least 90% homologous to amino acids 593-621 of Q9BTR2_HUMAN (SEQ ID NO:75), which also corresponds to amino acids 537-565 of HSU40434_P11 (SEQ ID NO:81), wherein said first amino acid sequence, first bridging amino acid, second amino acid sequence, third amino acid sequence, second bridging amino acid and fourth amino acid sequence are contiguous and in a sequential order.

An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n−2)−x), in which x varies from 0 to n−2.

An isolated chimeric polypeptide encoding for HSU40434_P11 (SEQ ID NO:81), comprising a first amino acid sequence being at least 90% homologous to amino acids 1-208 of NP_037536 (SEQ ID NO:76), which also corresponds to amino acids 1-208 of HSU40434_P11 (SEQ ID NO:81), a second amino acid sequence being at least 90% homologous to amino acids 266-410 of NP_037536 (SEQ ID NO:76), which also corresponds to amino acids 209-353 of HSU40434_P11 (SEQ ID NO:81), and a third amino acid sequence being at least 90% homologous to amino acids 419-630 of NP_037536 (SEQ ID NO:76), which also corresponds to amino acids 354-565 of HSU40434_P11 (SEQ ID NO:81), wherein said first amino acid sequence, second amino acid sequence and third amino acid sequence are contiguous and in a sequential order.

An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n−2)−x), in which x varies from 0 to n−2.

An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 353-x to 353; and ending at any of amino acid numbers 354+((n−2)−x), in which x varies from 0 to n−2.

An isolated chimeric polypeptide encoding for HSU40434_P11 (SEQ ID NO:81), comprising a first amino acid sequence being at least 90% homologous to amino acids 1-208 of Q9BR17_HUMAN (SEQ ID NO:73), which also corresponds to amino acids 1-208 of HSU40434_P11 (SEQ ID NO:81), a second amino acid sequence being at least 90% homologous to amino acids 266-410 of Q9BR17_HUMAN (SEQ ID NO:73), which also corresponds to amino acids 209-353 of HSU40434_P11 (SEQ ID NO:81), and a third amino acid sequence being at least 90% homologous to amino acids 419-630 of Q9BR17_HUMAN (SEQ ID NO:73), which also corresponds to amino acids 354-565 of HSU40434_P11 (SEQ ID NO:81), wherein said first amino acid sequence, second amino acid sequence and third amino acid sequence are contiguous and in a sequential order.

An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n−2)−x), in which x varies from 0 to n−2.

An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 353-x to 353; and ending at any of amino acid numbers 354+((n−2)−x), in which x varies from 0 to n−2.

An isolated chimeric polypeptide encoding for HSU40434_P11 (SEQ ID NO:81), comprising a first amino acid sequence being at least 70%, optionally at least 80%, preferably at least 85%, more preferably at least 90% and most preferably at least 95%, homologous to a polypeptide having the sequence MALPTARPLLGSCGTPALGSLL-FLLFSLGWVQPSRTLAGETGQEAA-PLDGVLANPPNISSL SPRQLLGFPCAEVSGLSTER-VRELAVALAQKNVKLSTEQLRCLAHRLSEPPEDLDAL PLDL LLFLNPDAFSGPQACTRFFSRITKAN-VDLLPRGAPERQRLLPAALACWGVRGSLLSEADV RALGGLACDLPGRFVAESAEVLLPRL-GIVAAWRQRSSRDPSWRQPERTILRPRFRRE (SEQ ID NO:531) corresponding to amino acids 1-239 of HSU40434_P11 (SEQ ID NO:81), a second amino acid sequence being at least 90% homologous to amino acids 1-296 of Q9UK57_HUMAN (SEQ ID NO:77), which also corresponds to amino acids 240-535 of HSU40434_P11 (SEQ ID NO:81), a first bridging amino acid M corresponding to amino acid 536 of HSU40434_P11 (SEQ ID NO:81), a second bridging amino acid Q corresponding to amino acid 298 of Q9UK57_HUMAN (SEQ ID NO:77), which also corresponds to amino acid 537 of HSU40434_P11 (SEQ ID NO:81), and a third amino acid sequence being at least 70%, optionally at least 80%, preferably at least 85%, more preferably at least 90% and most preferably at least 95% homologous to a polypeptide having the sequence EALSGTPCLLG-PGPVLTVLALLLASTLA (SEQ ID NO:532) corresponding to amino acids 538-565 of HSU40434_P11 (SEQ ID NO:81), wherein said first amino acid sequence, second amino acid sequence, first bridging amino acid, second bridging amino acid and third amino acid sequence are contiguous and in a sequential order.

An isolated polypeptide encoding for a head of HSU40434_P11 (SEQ ID NO:81), comprising a polypeptide being at least 70%, optionally at least about 80%, preferably at least about 85%, more preferably at least about 90% and most preferably at least about 95% homologous to the sequence MALPTARPLLGSCGTPALGSLLFLLFS-LGWVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLLPRL-GIVAAWRQRSSRDPSWRQPERTILRPRFRRE (SEQ ID NO:531) of HSU40434_P11 (SEQ ID NO:81).

An isolated polypeptide encoding for an edge portion of HSU40434_P11 (SEQ ID NO:81), comprising an amino acid sequence being at least 70%, optionally at least about 80%, preferably at least about 85%, more preferably at least about 90% and most preferably at least about 95% homologous to the sequence EALSGTPCLLGPGPVLTVLALLLASTLA (SEQ ID NO:532) of HSU40434_P11 (SEQ ID NO:81).

An isolated chimeric polypeptide encoding for HSU40434_P14 (SEQ ID NO:82), comprising a first amino acid sequence being at least 90% homologous to amino acids 1-170 of NP_005814 (SEQ ID NO:78), which also corresponds to amino acids 1-170 of HSU40434_P14 (SEQ ID NO:82), and a second amino acid sequence being at least 90% homologous to amino acids 266-622 of NP_005814 (SEQ ID NO:78), which also corresponds to amino acids 171-527 of HSU40434_P14 (SEQ ID NO:82), wherein said first amino acid sequence and second amino acid sequence are contiguous and in a sequential order.

An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)−x), in which x varies from 0 to n−2.

An isolated chimeric polypeptide encoding for HSU40434_P14 (SEQ ID NO:82), comprising a first amino acid sequence being at least 90% homologous to amino acids 1-170 of Q96KJ5_HUMAN (SEQ ID NO:79), which also corresponds to amino acids 1-170 of HSU40434_P14 (SEQ ID NO:82), and a second amino acid sequence being at least 90% homologous to amino acids 266-622 of Q96KJ5_HUMAN (SEQ ID NO:79), which also corresponds to amino acids 171-527 of HSU40434_P14 (SEQ ID NO:82), wherein said first amino acid sequence and second amino acid sequence are contiguous and in a sequential order.

An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)−x), in which x varies from 0 to n−2.

An isolated chimeric polypeptide encoding for HSU40434_P14 (SEQ ID NO:82), comprising a first amino acid sequence being at least 90% homologous to amino acids 1-170 of Q96GR6_HUMAN (SEQ ID NO:72), which also corresponds to amino acids 1-170 of HSU40434_P14 (SEQ ID NO:82), a second amino acid sequence being at least 90% homologous to amino acids 266-308 of Q96GR6_HUMAN (SEQ ID NO:72), which also corresponds to amino acids 171-213 of HSU40434_P14 (SEQ ID NO:82), a bridging amino acid R corresponding to amino acid 214 of HSU40434_P14 (SEQ ID NO:82), and a third amino acid sequence being at least 90% homologous to amino acids 310-622 of Q96GR6_HUMAN (SEQ ID NO:72), which also corresponds to amino acids 215-527 of HSU40434_P14 (SEQ ID NO:82), wherein said first amino acid sequence, second amino acid sequence, bridging amino acid and third amino acid sequence are contiguous and in a sequential order.

An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)−x), in which x varies from 0 to n−2.

An isolated chimeric polypeptide encoding for HSU40434_P14 (SEQ ID NO:82), comprising a first amino acid sequence being at least 90% homologous to amino acids 1-170 of Q14859_HUMAN (SEQ ID NO:74), which also corresponds to amino acids 1-170 of HSU40434_P14 (SEQ ID NO:82), a second amino acid sequence being at least 90% homologous to amino acids 266-592 of Q14859_HUMAN (SEQ ID NO:74), which also corresponds to amino acids 171-497 of HSU40434_P14 (SEQ ID NO:82), a bridging amino acid M corresponding to amino acid 498 of HSU40434_P14 (SEQ ID NO:82), and a third amino acid sequence being at least 90% homologous to amino acids 594-622 of Q14859_HUMAN (SEQ ID NO:74), which also corresponds to amino acids 499-527 of HSU40434_P14 (SEQ ID NO:82), wherein said first amino acid sequence, second amino acid sequence, bridging amino acid and third amino acid sequence are contiguous and in a sequential order.

An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)−x), in which x varies from 0 to n−2.

An isolated chimeric polypeptide encoding for HSU40434_P14 (SEQ ID NO:82), comprising a first amino acid sequence being at least 90% homologous to amino acids 1-43 of Q9BTR2_HUMAN (SEQ ID NO:75), which also corresponds to amino acids 1-43 of HSU40434_P14 (SEQ ID NO:82), a first bridging amino acid E corresponding to amino acids 44 of HSU40434_P14 (SEQ ID NO:82), a second amino acid sequence being at least 90% homologous to amino acids 44-169 of Q9BTR2_HUMAN (SEQ ID NO:75), which also corresponds to amino acids 45-170 of HSU40434_P14 (SEQ ID NO:82), a third amino acid sequence being at least 90% homologous to amino acids 265-591 of Q9BTR2_HUMAN (SEQ ID NO:75), which also corresponds to amino acids 171-497 of HSU40434_P14 (SEQ ID NO:82), a second bridging amino acid M corresponding to amino acid 498 of HSU40434_P14 (SEQ ID NO:82), and a fourth amino acid sequence being at least 90% homologous to amino acids 593-621 of Q9BTR2_HUMAN (SEQ ID NO:75), which also corresponds to amino acids 499-527 of HSU40434_P14 (SEQ ID NO:82), wherein said first amino acid sequence, first bridging amino acid, second amino acid sequence, third amino acid sequence, second bridging amino acid and fourth amino acid sequence are contiguous and in a sequential order.

An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)−x), in which x varies from 0 to n−2.

An isolated chimeric polypeptide encoding for HSU40434_P14 (SEQ ID NO:82), comprising a first amino acid sequence being at least 90% homologous to amino acids 1-170 of NP_037536 (SEQ ID NO:76), which also corresponds to amino acids 1-170 of HSU40434_P14 (SEQ ID NO:82), a second amino acid sequence being at least 90% homologous to amino acids 266-410 of NP_037536 (SEQ ID NO:76), which also corresponds to amino acids 171-315 of HSU40434_P14 (SEQ ID NO:82), and a third amino acid sequence being at least 90% homologous to amino acids 419-630 of NP_037536 (SEQ ID NO:76), which also corresponds to amino acids 316-527 of HSU40434_P14 (SEQ ID NO:82), wherein said first amino acid sequence, second amino acid sequence and third amino acid sequence are contiguous and in a sequential order.

An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)−x), in which x varies from 0 to n−2.

An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 315-x to 315; and ending at any of amino acid numbers 316+((n−2)−x), in which x varies from 0 to n−2.

An isolated chimeric polypeptide encoding for HSU40434_P14 (SEQ ID NO:82), comprising a first amino acid sequence being at least 90% homologous to amino acids 1-170 of Q9BR17_HUMAN (SEQ ID NO:73), which also corresponds to amino acids 1-170 of HSU40434_P14 (SEQ ID NO:82), a second amino acid sequence being at least 90% homologous to amino acids 266-410 of Q9BR17_HUMAN (SEQ ID NO:73), which also corresponds to amino acids 171-315 of HSU40434_P14 (SEQ ID NO:82), and a third amino acid sequence being at least 90% homologous to amino acids 419-630 of Q9BR17_HUMAN (SEQ ID NO:73), which also corresponds to amino acids 316-527 of HSU40434_P14 (SEQ ID NO:82), wherein said first amino acid sequence, second amino acid sequence and third amino acid sequence are contiguous and in a sequential order.

An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)−x), in which x varies from 0 to n−2.

An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 315-x to 315; and ending at any of amino acid numbers 316+((n−2)−x), in which x varies from 0 to n−2.

An isolated chimeric polypeptide encoding for HSU40434_P14 (SEQ ID NO:82), comprising a first amino acid sequence being at least 70%, optionally at least 80%, preferably at least 85%, more preferably at least 90% and most preferably at least 95%, homologous to a polypeptide having the sequence MALPTARPLLGSCGTPALGSLL-FLLFSLGWVQPSRTLAGETGQEAA-PLDGVLANPPNISSL SPRQLLGFPCAEVSGLSTER-VRELAVALAQKNVKLSTEQLRCLAHRLSEPPEDLDAL PLDL LLFLNPDAFSGPQACTRFFSRITKAN-VDLLPRGAPERQRLLPAALACWGIVAAWRQRSSR DPSWRQPERTILRPRFRRE (SEQ ID NO:536) corresponding to amino acids 1-201 of HSU40434_P14 (SEQ ID NO:82), a second amino acid sequence being at least 90% homologous to amino acids 1-296 of Q9UK57_HUMAN (SEQ ID NO:77), which also corresponds to amino acids 202-497 of HSU40434_P14 (SEQ ID NO:82), a first bridging amino acid M corresponding to amino acid 498 of HSU40434_P14 (SEQ ID NO:82), a second bridging amino acid Q corresponding to amino acid 298 of Q9UK57_HUMAN (SEQ ID NO:77), which also corresponds to amino acid 499 of HSU40434_P14 (SEQ ID NO:82), and a third amino acid sequence being at least 70%, optionally at least 80%, preferably at least 85%, more preferably at least 90% and most preferably at least 95% homologous to a polypeptide having the sequence EALSGTPCLLG-PGPVLTVLALLLASTLA (SEQ ID NO:532) corresponding to amino acids 500-527 of HSU40434_P14 (SEQ ID NO:82), wherein said first amino acid sequence, second amino acid sequence, first bridging amino acid, second bridging amino acid and third amino acid sequence are contiguous and in a sequential order.

An isolated polypeptide encoding for a head of HSU40434_P14 (SEQ ID NO:82), comprising a polypeptide being at least 70%, optionally at least about 80%, preferably at least about 85%, more preferably at least about 90% and most preferably at least about 95% homologous to the sequence MALPTARPLLGSCGTPALGSLLFLLFS-LGWVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGIVAAWRQRSSR DPSWRQPERTILRPRFRRE (SEQ ID NO:536) of HSU40434_P14 (SEQ ID NO:82).

An isolated polypeptide encoding for an edge portion of HSU40434_P14 (SEQ ID NO:82), comprising an amino acid sequence being at least 70%, optionally at least about 80%, preferably at least about 85%, more preferably at least about 90% and most preferably at least about 95% homologous to the sequence EALSGTPCLLGPGPVLTVLALLLASTLA (SEQ ID NO:532) of HSU40434_P14 (SEQ ID NO:82).

An isolated chimeric polypeptide encoding for HSU40434_P16 (SEQ ID NO:83), comprising a first amino acid sequence being at least 90% homologous to amino acids 1-410 of NP_005814 (SEQ ID NO:78), which also corresponds to amino acids 1-410 of HSU40434_P16 (SEQ ID NO:83), and a second amino acid sequence being at least 90% homologous to amino acids 486-622 of NP_005814 (SEQ ID NO:78), which also corresponds to amino acids 411-547 of HSU40434_P16 (SEQ ID NO:83), wherein said first amino acid sequence and second amino acid sequence are contiguous and in a sequential order.

An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

An isolated chimeric polypeptide encoding for HSU40434_P16 (SEQ ID NO:83), comprising a first amino acid sequence being at least 90% homologous to amino acids 1-410 of Q96KJ5_HUMAN (SEQ ID NO:79), which also corresponds to amino acids 1-410 of HSU40434_P16 (SEQ ID NO:83), and a second amino acid sequence being at least 90% homologous to amino acids 486-622 of Q96KJ5_HUMAN (SEQ ID NO:79), which also corresponds to amino acids 411-547 of HSU40434_P16 (SEQ ID NO:83), wherein said first amino acid sequence and second amino acid sequence are contiguous and in a sequential order.

An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

An isolated chimeric polypeptide encoding for HSU40434_P16 (SEQ ID NO:83), comprising a first amino acid sequence being at least 90% homologous to amino acids 1-308 of Q96GR6_HUMAN (SEQ ID NO:72), which also corresponds to amino acids 1-308 of HSU40434_P16 (SEQ ID NO:83), a bridging amino acid R corresponding to amino acid 309 of HSU40434_P16 (SEQ ID NO:83), a second amino acid sequence being at least 90% homologous to amino acids 310-410 of Q96GR6_HUMAN (SEQ ID NO:72), which also corresponds to amino acids 310-410 of HSU40434_P16 (SEQ ID NO:83), and a third amino acid sequence being at least 90% homologous to amino acids 486-622 of Q96GR6_HUMAN (SEQ ID NO:72), which also corresponds to amino acids 411-547 of HSU40434_P16 (SEQ ID NO:83), wherein said first amino acid sequence, bridging amino acid, second amino acid sequence and third amino acid sequence are contiguous and in a sequential order.

An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

An isolated chimeric polypeptide encoding for HSU40434_P16 (SEQ ID NO:83), comprising a first amino acid sequence being at least 90% homologous to amino acids 1-410 of Q14859_HUMAN (SEQ ID NO:74), which also corresponds to amino acids 1-410 of HSU40434_P16 (SEQ ID NO:83), a second amino acid sequence being at least 90% homologous to amino acids 486-592 of Q14859_HUMAN (SEQ ID NO:74), which also corresponds to amino acids 411-517 of HSU40434_P16 (SEQ ID NO:83), a bridging amino acid M corresponding to amino acid 518 of HSU40434_P16 (SEQ ID NO:83), and a third amino acid sequence being at least 90% homologous to amino acids 594-622 of Q14859_HUMAN (SEQ ID NO:74), which also corresponds to amino acids 519-547 of HSU40434_P16 (SEQ ID NO:83), wherein said first amino acid sequence, second amino acid sequence, bridging amino acid and third amino acid sequence are contiguous and in a sequential order.

An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

An isolated chimeric polypeptide encoding for HSU40434_P16 (SEQ ID NO:83), comprising a first amino acid sequence being at least 90% homologous to amino acids 1-43 of Q9BTR2_HUMAN (SEQ ID NO:75), which also corresponds to amino acids 1-43 of HSU40434_P16 (SEQ ID NO:83), a first bridging amino acid E corresponding to amino acid 44 of HSU40434_P16 (SEQ ID NO:83), a second amino acid sequence being at least 90% homologous to amino acids 44-409 of Q9BTR2_HUMAN (SEQ ID NO:75), which also corresponds to amino acids 45-410 of HSU40434_P16 (SEQ ID NO:83), a third amino acid sequence being at least 90% homologous to amino acids 485-591 of Q9BTR2_HUMAN (SEQ ID NO:75), which also corresponds to amino acids 411-517 of HSU40434_P16 (SEQ ID NO:83), a second bridging amino acid M corresponding to amino acid 518 of HSU40434_P16 (SEQ ID NO:83), and a forth amino acid sequence being at least 90% homologous to amino acids 593-621 of Q9BTR2_HUMAN (SEQ ID NO:75), which also corresponds to amino acids 519-547 of HSU40434_P16 (SEQ ID NO:83), wherein said first amino acid sequence, first bridging amino acid, second amino acid sequence, third amino acid sequence, second bridging amino acid and fourth amino acid sequence are contiguous and in a sequential order.

An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

An isolated chimeric polypeptide encoding for HSU40434_P16 (SEQ ID NO:83), comprising a first amino acid sequence being at least 90% homologous to amino acids 1-410 of NP_037536 (SEQ ID NO:76), which also corresponds to amino acids 1-410 of HSU40434_P16 (SEQ ID NO:83), and a second amino acid sequence being at least 90% homologous to amino acids 494-630 of NP_037536 (SEQ ID NO:76), which also corresponds to amino acids 411-547 of HSU40434_P16 (SEQ ID NO:83), wherein said first amino acid sequence and second amino acid sequence are contiguous and in a sequential order.

An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

An isolated chimeric polypeptide encoding for HSU40434_P16 (SEQ ID NO:83), comprising a first amino acid sequence being at least 90% homologous to amino acids 1-410 of Q9BR17_HUMAN (SEQ ID NO:73), which also corresponds to amino acids 1-410 of HSU40434_P16 (SEQ ID NO:83), and a second amino acid sequence being at least 90% homologous to NMNGSEYFVKIQSFLGGAPTEDL-KALSQQNVSMDLATFMKLRTDAVLPLTVAEVQKLLG PHVEGLKAEERHRPVRDWILRQRQD-DLDTLGLGLQGGIPNGYLVLDLSMQEALSGTPCLL GPGPVLTVLALLLASTLA corresponding to amino acids 494-630 of Q9BR17_HUMAN (SEQ ID NO:73), which also corresponds to amino acids 411-547 of HSU40434_P16 (SEQ ID NO:83), wherein said first amino acid sequence and second amino acid sequence are contiguous and in a sequential order.

An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

An isolated chimeric polypeptide encoding for HSU40434_P18 (SEQ ID NO:84), comprising a first amino acid sequence being at least 90% homologous to amino acids 1-100 of NP_005814 (SEQ ID NO:78), which also corresponds to amino acids 1-100 of HSU40434_P18 (SEQ ID NO:84), and a second amino acid sequence being at least 90% homologous to amino acids 266-622 of NP_005814 (SEQ ID NO:78), which also corresponds to amino acids 101-457 of HSU40434_P18 (SEQ ID NO:84), wherein said first amino acid sequence and second amino acid sequence are contiguous and in a sequential order.

An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

An isolated chimeric polypeptide encoding for HSU40434_P18 (SEQ ID NO:84), comprising a first amino acid sequence being at least 90% homologous to amino acids 1-100 of Q96KJ5_HUMAN (SEQ ID NO:79), which also corresponds to amino acids 1-100 of HSU40434_P18 (SEQ ID NO:84), and a second amino acid sequence being at least 90% homologous to amino acids 266-622 of Q96KJ5_HUMAN (SEQ ID NO:79), which also corresponds to amino acids 101-457 of HSU40434_P18 (SEQ ID NO:84), wherein said first amino acid sequence and second amino acid sequence are contiguous and in a sequential order.

An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

An isolated chimeric polypeptide encoding for HSU40434_P18 (SEQ ID NO:84), comprising a first amino acid sequence being at least 90% homologous to amino acids 1-100 of Q96GR6_HUMAN (SEQ ID NO:72), which also corresponds to amino acids 1-100 of HSU40434_P18 (SEQ ID NO:84), a second amino acid sequence being at least 90% homologous to amino acids 266-308 of Q96GR6_HUMAN (SEQ ID NO:72), which also corresponds to amino acids 101-143 of HSU40434_P18 (SEQ ID NO:84), a bridging amino acid R corresponding to amino acid 144 of HSU40434_P18 (SEQ ID NO:84), and a third amino acid sequence being at least 90% homologous to amino acids 310-622 of Q96GR6_HUMAN (SEQ ID NO:72), which also corresponds to amino acids 145-457 of HSU40434_P18 (SEQ ID NO:84), wherein said first amino acid sequence, second amino acid sequence, bridging amino acid and third amino acid sequence are contiguous and in a sequential order.

An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

An isolated chimeric polypeptide encoding for HSU40434_P18 (SEQ ID NO:84), comprising a first amino acid sequence being at least 90% homologous to amino acids 1-100 of Q14859_HUMAN (SEQ ID NO:74), which also corresponds to amino acids 1-100 of HSU40434_P18 (SEQ ID NO:84), a second amino acid sequence being at least 90% homologous to amino acids 266-592 of Q14859_HUMAN (SEQ ID NO:74), which also corresponds to amino acids 101-427 of HSU40434_P18 (SEQ ID NO:84), a bridging amino acid M corresponding to amino acid 428 of HSU40434_P18 (SEQ ID NO:84), and a third amino acid sequence being at least 90% homologous to amino acids 594-622 of Q14859_HUMAN (SEQ ID NO:74), which also corresponds to amino acids 429-457 of HSU40434_P18 (SEQ ID NO:84), wherein said first amino acid sequence, second amino acid sequence, bridging amino acid and third amino acid sequence are contiguous and in a sequential order.

An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

An isolated chimeric polypeptide encoding for HSU40434_P18 (SEQ ID NO:84), comprising a first amino acid sequence being at least 90% homologous to amino acids 1-43 of Q9BTR2_HUMAN (SEQ ID NO:75), which also corresponds to amino acids 1-43 of HSU40434_P18 (SEQ ID NO:84), a first bridging amino acid E corresponding to amino acid 44 of HSU40434_P18 (SEQ ID NO:84), a second amino acid sequence being at least 90% homologous to amino acids 44-99 of Q9BTR2_HUMAN (SEQ ID NO:75), which also corresponds to amino acids 45-100 of HSU40434_P18 (SEQ ID NO:84), a third amino acid sequence being at least 90% homologous to amino acids 265-591 of Q9BTR2_HUMAN (SEQ ID NO:75), which also corresponds to amino acids 101-427 of HSU40434_P18 (SEQ ID NO:84), a second bridging amino acid M corresponding to amino acid 428 of HSU40434_P18 (SEQ ID NO:84), and a fourth amino acid sequence being at least 90% homologous to amino acids 593-621 of Q9BTR2_HUMAN (SEQ ID NO:75), which also corresponds to amino acids 429-457 of HSU40434_P18 (SEQ ID NO:84), wherein said first amino acid sequence, first bridging amino acid second amino acid sequence, third amino acid sequence, second bridging amino acid and fourth amino acid sequence are contiguous and in a sequential order.

An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

An isolated chimeric polypeptide encoding for HSU40434_P18 (SEQ ID NO:84), comprising a first amino acid sequence being at least 90% homologous to amino acids 1-100 of NP_037536 (SEQ ID NO:76), which also corresponds to amino acids 1-100 of HSU40434_P18 (SEQ ID NO:84), a second amino acid sequence being at least 90% homologous to amino acids 266-410 of NP_037536 (SEQ ID NO:76), which also corresponds to amino acids 101-245 of HSU40434_P18 (SEQ ID NO:84), and a third amino acid sequence being at least 90% homologous to amino acids 419-630 of NP_037536 (SEQ ID NO:76), which also corresponds to amino acids 246-457 of HSU40434_P18 (SEQ ID NO:84), wherein said first amino acid sequence, second amino acid sequence and third amino acid sequence are contiguous and in a sequential order.

An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 245-x to 245; and ending at any of amino acid numbers 246+((n−2)−x), in which x varies from 0 to n−2.

An isolated chimeric polypeptide encoding for HSU40434_P18 (SEQ ID NO:84), comprising a first amino acid sequence being at least 90% homologous to amino acids 1-100 of Q9BR17_HUMAN (SEQ ID NO:73), which also corresponds to amino acids 1-100 of HSU40434_P18 (SEQ ID NO:84), a second amino acid sequence being at least 90% homologous to amino acids 266-410 of Q9BR17_HUMAN (SEQ ID NO:73), which also corresponds to amino acids 101-245 of HSU40434_P18 (SEQ ID NO:84), and a third amino acid sequence being at least 90% homologous to amino acids 419-630 of Q9BR17_HUMAN (SEQ ID NO:73), which also corresponds to amino acids 246-457 of HSU40434_P18 (SEQ ID NO:84), wherein said first amino acid sequence, second amino acid sequence and third amino acid sequence are contiguous and in a sequential order.

An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 245-x to 245; and ending at any of amino acid numbers 246+((n−2)−x), in which x varies from 0 to n−2.

An isolated chimeric polypeptide encoding for HSU40434_P18 (SEQ ID NO:84), comprising a first amino acid sequence being at least 70%, optionally at least 80%, preferably at least 85%, more preferably at least 90% and most preferably at least 95%, homologous to a polypeptide having the sequence MALPTARPLLGSCGTPALGSLL-FLLFSLGWVQPSRTLAGETGQEAA-PLDGVLANPPNISSL SPRQLLGFPCAEVSGLSTER-VRELAVALAQKNVKLSTEQGIVAAWRQRSSRDPSWR QPER TILRPRFRRE (SEQ ID NO:544) corresponding to amino acids 1-131 of HSU40434_P18 (SEQ ID NO:84), a second amino acid sequence being at least 90% homologous to amino acids 1-296 of Q9UK57_HUMAN (SEQ ID NO:77), which also corresponds to amino acids 132-427 of HSU40434_P18 (SEQ ID NO:84), a first bridging amino acid M corresponding to amino acid 428 of HSU40434_P18 (SEQ ID NO:84), a second bridging amino acid Q corresponding to amino acid298 of Q9UK57_HUMAN (SEQ ID NO:77), which also corresponds to amino acid429 of HSU40434_P18 (SEQ ID NO:84), and a third amino acid sequence being at least 70%, optionally at least 80%, preferably at least 85%, more preferably at least 90% and most preferably at least 95% homologous to a polypeptide having the sequence EALSGT-PCLLGPGPVLTVLALLLASTLA (SEQ ID NO:532) corresponding to amino acids 430-457 of HSU40434_P18 (SEQ ID NO:84), wherein said first amino acid sequence, second amino acid sequence, first bridging amino acid, second bridging amino acid and third amino acid sequence are contiguous and in a sequential order.

An isolated polypeptide encoding for a head of HSU40434_P18 (SEQ ID NO:84), comprising a polypeptide being at least 70%, optionally at least about 80%, preferably at least about 85%, more preferably at least about 90% and most preferably at least about 95% homologous to the sequence MALPTARPLLGSCGTPALGSLLFLLFS-LGWVQPSRTLAGETGQEAAPLDGVLANPPNISSL SPRQLLGFPCAEVSGLSTERVRELAVA-LAQKNVKLSTEQGIVAAWRQRSSRDPSWRQPER TIL-RPRFRRE (SEQ ID NO:544) of HSU40434_P18 (SEQ ID NO:84).

An isolated polypeptide encoding for an edge portion of HSU40434_P18 (SEQ ID NO:84), comprising an amino acid sequence being at least 70%, optionally at least about 80%, preferably at least about 85%, more preferably at least about 90% and most preferably at least about 95% homologous to the sequence EALSGTPCLLGPGPVLTVLALLLASTLA (SEQ ID NO:532) of HSU40434_P18 (SEQ ID NO:84).

An isolated chimeric polypeptide encoding for M62246_1_P9 (SEQ ID NO:111), comprising a first amino acid sequence being at least 90% homologous to amino acids 68-155 of NP_060331, which also corresponds to amino acids 1-88 of M62246_1_P9 (SEQ ID NO:111), a bridging amino acid E corresponding to amino acid 89 of M62246_1_P9 (SEQ ID NO: 111), and a second amino acid sequence being at least 90% homologous to amino acids 157-217 of NP_060331, which also corresponds to amino acids 90-150 of M62246_1_P9 (SEQ ID NO:111), wherein said, first amino acid sequence, bridging amino acid and second amino acid sequence are contiguous and in a sequential order.

An isolated chimeric polypeptide encoding for M62246_1_P9 (SEQ ID NO:111), comprising a first amino acid sequence being at least 90% homologous to amino acids 68-155 of Q8TBF5_HUMAN (SEQ ID NO:109), which also corresponds to amino acids 1-88 of M62246__1_P9 (SEQ ID NO:111), a bridging amino acid E corresponding to amino acid 89 of M62246__1_P9 (SEQ ID NO: 111), and a second amino acid sequence being at least 90% homologous to amino acids 157-217 of Q8TBF5_HUMAN (SEQ ID NO:109), which also corresponds to amino acids 90-150 of M62246__1_P9 (SEQ ID NO:111), wherein said, first amino acid sequence, bridging amino acid and second amino acid sequence are contiguous and in a sequential order.

An isolated chimeric polypeptide encoding for M62246__1_P9 (SEQ ID NO:111), comprising a first amino acid sequence being at least 90% homologous to amino acids 68-136 of Q9NWZ2_HUMAN (SEQ ID NO:110), which also corresponds to amino acids 1-69 of M62246__1_P9 (SEQ ID NO:111), a second amino acid sequence being at least 90% homologous to amino acids 155-220 of Q9NWZ2_HUMAN (SEQ ID NO:110), which also corresponds to amino acids 70-135 of M62246__1_P9 (SEQ ID NO:111), and a third amino acid sequence being at least 70%, optionally at least 80%, preferably at least 85%, more preferably at least 90% and most preferably at least 95% homologous to a polypeptide having the sequence TLILVAVFKYGHFSL (SEQ ID NO:546) corresponding to amino acids 136-150 of M62246__1_P9 (SEQ ID NO:111), wherein said, first amino acid sequence, second amino acid sequence and third amino acid sequence are contiguous and in a sequential order.

An isolated chimeric polypeptide encoding for an edge portion of M62246__1_P9 (SEQ ID NO:111), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QE, having a structure as follows: a sequence starting from any of amino acid numbers 69−x to 69; and ending at any of amino acid numbers 70+((n−2)−x), in which x varies from 0 to n−2.

An isolated polypeptide encoding for an edge portion of M62246__1_P9 (SEQ ID NO:111), comprising an amino acid sequence being at least 70%, optionally at least about 80%, preferably at least about 85%, more preferably at least about 90% and most preferably at least about 95% homologous to the sequence TLILVAVFKYGHFSL (SEQ ID NO:546) of M62246__1_P9 (SEQ ID NO:111).

An isolated chimeric polypeptide encoding for M62246__1_P12 (SEQ ID NO:112), comprising a first amino acid sequence being at least 90% homologous to amino acids 1-220 of Q9NWZ2_HUMAN (SEQ ID NO:110), which also corresponds to amino acids 1-220 of M62246__1_P12 (SEQ ID NO:112), and a second amino acid sequence being at least 70%, optionally at least 80%, preferably at least 85%, more preferably at least 90% and most preferably at least 95% homologous to a polypeptide having the sequence TLILVAVFKYGHFSL (SEQ ID NO:546) corresponding to amino acids 221-235 of M62246__1_P12 (SEQ ID NO:112), wherein said first amino acid sequence and second amino acid sequence are contiguous and in a sequential order.

An isolated polypeptide encoding for an edge portion of M62246__1_P12 (SEQ ID NO:112), comprising an amino acid sequence being at least 70%, optionally at least about 80%, preferably at least about 85%, more preferably at least about 90% and most preferably at least about 95% homologous to the sequence TLILVAVFKYGHFSL (SEQ ID NO:546) of M62246__1_P12 (SEQ ID NO:112).

An isolated chimeric polypeptide encoding for M62246__1_P12 (SEQ ID NO:112), comprising a first amino acid sequence being at least 90% homologous to amino acids 1-136 of NP__060331, which also corresponds to amino acids 1-136 of M62246__1_P12 (SEQ ID NO:112), a second amino acid sequence being at least 70%, optionally at least 80%, preferably at least 85%, more preferably at least 90% and most preferably at least 95% homologous to a polypeptide having the sequence AGSRRMIRFRFDSFDKTI (SEQ ID NO:548) corresponding to amino acids 137-154 of M62246__1_P12 (SEQ ID NO:112), a third amino acid sequence being at least 90% homologous to amino acids 137-155 of NP__060331, which also corresponds to amino acids 155-173 of M62246__1_P12 (SEQ ID NO:112), a bridging amino acid E corresponding to amino acid 174 of M62246__1_P12 (SEQ ID NO:112), and a fourth amino acid sequence being at least 90% homologous to amino acids 157-217 of NP__060331, which also corresponds to amino acids 175-235 of M62246__1_P12 (SEQ ID NO:112), wherein said first amino acid sequence, second amino acid sequence, third amino acid sequence, bridging amino acid and fourth amino acid sequence are contiguous and in a sequential order.

An isolated polypeptide encoding for an edge portion of M62246__1_P12 (SEQ ID NO:112), comprising an amino acid sequence being at least 70%, optionally at least about 80%, preferably at least about 85%, more preferably at least about 90% and most preferably at least about 95% homologous to the sequence AGSRRMIRFRFDSFDKTI (SEQ ID NO:548) of M62246__1_P12 (SEQ ID NO:112).

An isolated chimeric polypeptide encoding for M62246__1_P12 (SEQ ID NO:112), comprising a first amino acid sequence being at least 90% homologous to amino acids 1-136 of Q8TBF5_HUMAN (SEQ ID NO:109), which also corresponds to amino acids 1-136 of M62246__1_P12 (SEQ ID NO:112), a second amino acid sequence being at least 70%, optionally at least 80%, preferably at least 85%, more preferably at least 90% and most preferably at least 95% homologous to a polypeptide having the sequence AGSRRMIRFRFDSFDKTI (SEQ ID NO:548) corresponding to amino acids 137-154 of M62246__1_P12 (SEQ ID NO:112), a third amino acid sequence being at least 90% homologous to amino acids 137-155 of Q8TBF5_HUMAN (SEQ ID NO:109), which also corresponds to amino acids 155-173 of M62246__1_P12 (SEQ ID NO:112), a bridging amino acid E corresponding to amino acid 174 of M62246__1_P12 (SEQ ID NO:112), and a fourth amino acid sequence being at least 90% homologous to amino acids 157-217 of Q8TBF5_HUMAN (SEQ ID NO:109), which also corresponds to amino acids 175-235 of M62246__1_P12 (SEQ ID NO:112), wherein said first amino acid sequence, second amino acid sequence, third amino acid sequence, bridging amino acid and fourth amino acid sequence are contiguous and in a sequential order.

An isolated polypeptide encoding for an edge portion of M62246__1_P12 (SEQ ID NO:112), comprising an amino acid sequence being at least 70%, optionally at least about 80%, preferably at least about 85%, more preferably at least about 90% and most preferably at least about 95% homologous to the sequence AGSRRMIRFRFDSFDKTI (SEQ ID NO:548) of M62246__1_P12 (SEQ ID NO:112).

An isolated chimeric polypeptide encoding for M62246__1_P13 (SEQ ID NO:113), comprising a first amino acid sequence being at least 90% homologous to amino acids 1-155 of NP__060331, which also corresponds to amino acids 1-155 of M62246__1_P13 (SEQ ID NO:113), a bridging amino acid E corresponding to amino acid 156 of M62246__1_P13 (SEQ ID NO:113), a second amino acid sequence being at least 90% homologous to amino acids 157-170 of NP__060331, which also corresponds to amino acids 157-170 of M62246_1_P13 (SEQ ID NO:113), and a third amino acid sequence being at least 70%, optionally at least 80%, preferably at least 85%, more preferably at least 90% and most preferably at least 95% homologous to a polypeptide having the sequence TGFHRISQDGLDLLTS (SEQ ID NO:549) corresponding to amino acids 171-186 of M62246_1_P13 (SEQ ID NO:113), wherein said first amino acid sequence, bridging amino acid, second amino acid sequence and third amino acid sequence are contiguous and in a sequential order.

An isolated polypeptide encoding for an edge portion of M62246_1_P13 (SEQ ID NO:113), comprising an amino acid sequence being at least 70%, optionally at least about 80%, preferably at least about 85%, more preferably at least about 90% and most preferably at least about 95% homologous to the sequence TGFHRISQDGLDLLTS (SEQ ID NO:549) of M62246_1_P13 (SEQ ID NO:113).

An isolated chimeric polypeptide encoding for M62246_1_P13 (SEQ ID NO:113), comprising a first amino acid sequence being at least 90% homologous to amino acids 1-155 of Q8TBF5_HUMAN (SEQ ID NO:109), which also corresponds to amino acids 1-155 of M62246_1_P13 (SEQ ID NO:113), a bridging amino acid E corresponding to amino acid 156 of M62246_1_P13 (SEQ ID NO:113), a second amino acid sequence being at least 90% homologous to amino acids 157-170 of Q8TBF5_HUMAN (SEQ ID NO:109), which also corresponds to amino acids 157-170 of M62246_1_P13 (SEQ ID NO:113), and a third amino acid sequence being at least 70%, optionally at least 80%, preferably at least 85%, more preferably at least 90% and most preferably at least 95% homologous to a polypeptide having the sequence TGFHRISQDGLDLLTS (SEQ ID NO:549) corresponding to amino acids 171-186 of M62246_1_P13 (SEQ ID NO:113), wherein said first amino acid sequence, bridging amino acid, second amino acid sequence and third amino acid sequence are contiguous and in a sequential order.

An isolated polypeptide encoding for an edge portion of M62246_1_P13 (SEQ ID NO:113), comprising an amino acid sequence being at least 70%, optionally at least about 80%, preferably at least about 85%, more preferably at least about 90% and most preferably at least about 95% homologous to the sequence TGFHRISQDGLDLLTS (SEQ ID NO:549) of M62246_1_P13 (SEQ ID NO:113).

An isolated chimeric polypeptide encoding for M62246_1_P13 (SEQ ID NO:113), comprising a first amino acid sequence being at least 90% homologous to corresponding to amino acids 1-136 of Q9NWZ2_HUMAN (SEQ ID NO:110), which also corresponds to amino acids 1-136 of M62246_1_P13 (SEQ ID NO:113), a second amino acid sequence being at least 90% homologous to amino acids 155-188 of Q9NWZ2_HUMAN (SEQ ID NO:110), which also corresponds to amino acids 137-170 of M62246_1_P13 (SEQ ID NO:113), and a third amino acid sequence being at least 70%, optionally at least 80%, preferably at least 85%, more preferably at least 90% and most preferably at least 95% homologous to a polypeptide having the sequence TGF-HRISQDGLDLLTS (SEQ ID NO:549) corresponding to amino acids 171-186 of M62246_1_P13 (SEQ ID NO:113), wherein said first amino acid sequence, second amino acid sequence and third amino acid sequence are contiguous and in a sequential order.

An isolated chimeric polypeptide encoding for an edge portion of M62246_1_P13 (SEQ ID NO:113), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QE, having a structure as follows: a sequence starting from any of amino acid numbers 136-x to 136; and ending at any of amino acid numbers 137+((n−2)−x), in which x varies from 0 to n−2.

An isolated polypeptide encoding for an edge portion of M62246_1_P13 (SEQ ID NO:113), comprising an amino acid sequence being at least 70%, optionally at least about 80%, preferably at least about 85%, more preferably at least about 90% and most preferably at least about 95% homologous to the sequence TGFHRISQDGLDLLTS (SEQ ID NO:549) of M62246_1_P13 (SEQ ID NO:113).

An isolated chimeric polypeptide encoding for M78076_P5 (SEQ ID NO:169), comprising a first amino acid sequence being at least 90% homologous to amino acids 1-517 of APLP1_HUMAN (SEQ ID NO:591), which also corresponds to amino acids 1-517 of M78076_P5 (SEQ ID NO:169), and a second amino acid sequence having the sequence GE corresponding to amino acids 518-519 of M78076_P5 (SEQ ID NO:169), wherein said first amino acid sequence and second amino acid sequence are contiguous and in a sequential order.

An isolated chimeric polypeptide encoding for M78076_P5 (SEQ ID NO:169), comprising a first amino acid sequence being at least 90% homologous to amino acids 1-517 of NP_005157 (SEQ ID NO:167), which also corresponds to amino acids 1-517 of M78076_P5 (SEQ ID NO:169), and a second amino acid sequence having the sequence GE (SEQ ID NO:550) corresponding to amino acids 518-519 of M78076_P5 (SEQ ID NO:169), wherein said first amino acid sequence and second amino acid sequence are contiguous and in a sequential order.

An isolated chimeric polypeptide encoding for M78076_P6 (SEQ ID NO:170), comprising a first amino acid sequence being at least 90% homologous to amino acids 1-525 of APLP1_HUMAN (SEQ ID NO:591), which also corresponds to amino acids 1-525 of M78076_P6 (SEQ ID NO:170), a second amino acid sequence being at least 70%, optionally at least 80%, preferably at least 85%, more preferably at least 90% and most preferably at least 95% homologous to a polypeptide having the sequence DLGV (SEQ ID NO:551) corresponding to amino acids 526-529 of M78076_P6 (SEQ ID NO:170), and a third amino acid sequence being at least 90% homologous to amino acids 526-650 of APLP1_HUMAN (SEQ ID NO:591), which also corresponds to amino acids 530-654 of M78076_P6 (SEQ ID NO:170), wherein said first amino acid sequence, second amino acid sequence and third amino acid sequence are contiguous and in a sequential order.

An isolated polypeptide encoding for an edge portion of M78076_P6 (SEQ ID NO:170), comprising an amino acid sequence being at least 70%, optionally at least about 80%, preferably at least about 85%, more preferably at least about 90% and most preferably at least about 95% homologous to the sequence DLGV (SEQ ID NO:551) of M78076_P6 (SEQ ID NO:170).

An isolated chimeric polypeptide encoding for M78076_P6 (SEQ ID NO:170), comprising a first amino acid sequence being at least 90% homologous to amino acids 1-525 of NP_005157 (SEQ ID NO:167), which also corresponds to amino acids 1-525 of M78076_P6 (SEQ ID NO:170), a second amino acid sequence being at least 70%, optionally at least 80%, preferably at least 85%, more preferably at least 90% and most preferably at least 95% homologous to a polypeptide having the sequence DLGV (SEQ ID NO:551) corresponding to amino acids 526-529 of M78076_P6 (SEQ ID NO:170), and a third amino acid sequence being at least 90% homologous to amino acids 526-650 of NP_005157 (SEQ ID NO:167), which also corresponds to amino acids 530-654 of M78076_P6 (SEQ ID NO:170), wherein said first amino acid sequence, second amino acid sequence and third amino acid sequence are contiguous and in a sequential order.

An isolated polypeptide encoding for an edge portion of M78076_P6 (SEQ ID NO:170), comprising an amino acid sequence being at least 70%, optionally at least about 80%, preferably at least about 85%, more preferably at least about 90% and most preferably at least about 95% homologous to the sequence DLGV (SEQ ID NO:551) of M78076_P6 (SEQ ID NO:170).

An isolated chimeric polypeptide encoding for M78076_P7 (SEQ ID NO:171), comprising a first amino acid sequence being at least 90% homologous to amino acids 1-526 of APLP1_HUMAN (SEQ ID NO:591), which also corresponds to amino acids 1-526 of M78076_P7 (SEQ ID NO:171), and a second amino acid sequence being at least 70%, optionally at least 80%, preferably at least 85%, more preferably at least 90% and most preferably at least 95% homologous to a polypeptide having the sequence ECLTVNPSLQIPLNP (SEQ ID NO:552) corresponding to amino acids 527-541 of M78076_P7 (SEQ ID NO:171), wherein said first amino acid sequence and second amino acid sequence are contiguous and in a sequential order.

An isolated polypeptide encoding for an edge portion of M78076 P7 (SEQ ID NO:171), comprising an amino acid sequence being at least 70%, optionally at least about 80%, preferably at least about 85%, more preferably at least about 90% and most preferably at least about 95% homologous to the sequence ECLTVNPSLQIPLNP (SEQ ID NO:552) of M78076_P7 (SEQ ID NO:171).

An isolated chimeric polypeptide encoding for M78076_P7 (SEQ ID NO:171), comprising a first amino acid sequence being at least 90% homologous to amino acids 1-526 of NP_005157 (SEQ ID NO:167), which also corresponds to amino acids 1-526 of M78076_P7 (SEQ ID NO:171), and a second amino acid sequence being at least 70%, optionally at least 80%, preferably at least 85%, more preferably at least 90% and most preferably at least 95% homologous to a polypeptide having the sequence ECLTVNPSLQIPLNP (SEQ ID NO:552) corresponding to amino acids 527-541 of M78076_P7 (SEQ ID NO:171), wherein said first amino acid sequence and second amino acid sequence are contiguous and in a sequential order.

An isolated polypeptide encoding for an edge portion of M78076_P7 (SEQ ID NO:171), comprising an amino acid sequence being at least 70%, optionally at least about 80%, preferably at least about 85%, more preferably at least about 90% and most preferably at least about 95% homologous to the sequence ECLTVNPSLQIPLNP (SEQ ID NO:552) of M78076_P7 (SEQ ID NO:171).

An isolated chimeric polypeptide encoding for M78076_P11 (SEQ ID NO:172), comprising a first amino acid sequence being at least 90% homologous to amino acids 1-570 of APLP1_HUMAN (SEQ ID NO:591), which also corresponds to amino acids 1-570 of M78076_P11 (SEQ ID NO:172), and a second amino acid sequence being at least 70%, optionally at least 80%, preferably at least 85%, more preferably at least 90% and most preferably at least 95% homologous to a polypeptide having the sequence VRGG-TAGYLGEETRGQRPGCDSQSHTGPSKKP-SAPSPLPAGTSWDRGVP (SEQ ID NO:553) corresponding to amino acids 571-619 of M78076_P11 (SEQ ID NO:172), wherein said first amino acid sequence and second amino acid sequence are contiguous and in a sequential order.

An isolated polypeptide encoding for an edge portion of M78076_P11 (SEQ ID NO:172), comprising an amino acid sequence being at least 70%, optionally at least about 80%, preferably at least about 85%, more preferably at least about 90% and most preferably at least about 95% homologous to the sequence VRGGTAGYLGEETRGQRPGCDSQSHT-GPSKKPSAPSPLPAGTSWDRGVP (SEQ ID NO:553) of M78076_P11 (SEQ ID NO:172).

An isolated chimeric polypeptide encoding for M78076_P11 (SEQ ID NO:172), comprising a first amino acid sequence being at least 90% homologous to amino acids 1-570 of NP_005157 (SEQ ID NO:167), which also corresponds to amino acids 1-570 of M78076_P11 (SEQ ID NO:172), and a second amino acid sequence being at least 70%, optionally at least 80%, preferably at least 85%, more preferably at least 90% and most preferably at least 95% homologous to a polypeptide having the sequence VRGG-TAGYLGEETRGQRPGCDSQSHTGPSKKP-SAPSPLPAGTSWDRGVP (SEQ ID NO:553) corresponding to amino acids 571-619 of M78076_P11 (SEQ ID NO:172), wherein said first amino acid sequence and second amino acid sequence are contiguous and in a sequential order.

An isolated polypeptide encoding for an edge portion of M78076_P11 (SEQ ID NO:172), comprising an amino acid sequence being at least 70%, optionally at least about 80%, preferably at least about 85%, more preferably at least about 90% and most preferably at least about 95% homologous to the sequence VRGGTAGYLGEETRGQRPGCDSQSHT-GPSKKPSAPSPLPAGTSWDRGVP (SEQ ID NO:553) of M78076_P11 (SEQ ID NO:172).

An isolated chimeric polypeptide encoding for M78076_P16 (SEQ ID NO:173), comprising a first amino acid sequence being at least 90% homologous to amino acids 1-352 of APLP1_HUMAN (SEQ ID NO:591), which also corresponds to amino acids 1-352 of M78076_P16 (SEQ ID NO:173), and a second amino acid sequence being at least 90% homologous to amino acids 406-650 of APLP1_HUMAN (SEQ ID NO:591), which also corresponds to amino acids 353-597 of M78076_P16 (SEQ ID NO:173), wherein said first amino acid sequence and second amino acid sequence are contiguous and in a sequential order.

An isolated chimeric polypeptide encoding for an edge portion of M78076_P16 (SEQ ID NO:173), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 352-x to 352; and ending at any of amino acid numbers 353+((n−2)−x), in which x varies from 0 to n−2.

An isolated chimeric polypeptide encoding for M78076_P16 (SEQ ID NO:173), comprising a first amino acid sequence being at least 90% homologous to sequence corresponding to amino acids 1-352 of NP_005157 (SEQ ID NO:167), which also corresponds to amino acids 1-352 of M78076 P16 (SEQ ID NO:173), and a second amino acid sequence being at least 90% homologous to amino acids 406-650 of NP_005157 (SEQ ID NO:167), which also corresponds to amino acids 353-597 of M78076_P16 (SEQ ID NO:173), wherein said first amino acid sequence and second amino acid sequence are contiguous and in a sequential order.

An isolated chimeric polypeptide encoding for an edge portion of M78076_P16 (SEQ ID NO:173), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 352-x to 352; and ending at any of amino acid numbers 353+((n−2)−x), in which x varies from 0 to n−2.

An isolated chimeric polypeptide encoding for M78076_P17 (SEQ ID NO:174), comprising a first amino acid sequence being at least 90% homologous to sequence corresponding to amino acids 1-526 of APLP1_HUMAN (SEQ ID NO:591), which also corresponds to amino acids 1-526 of M78076_P17 (SEQ ID NO:174), and a second amino acid sequence being at least 70%, optionally at least 80%, preferably at least 85%, more preferably at least 90% and most preferably at least 95% homologous to a polypeptide having the sequence ECVCSKGFPFPLIGDSEG (SEQ ID NO:554) corresponding to amino acids 527-544 of M78076_P17 (SEQ ID NO:174), wherein said first amino acid sequence and second amino acid sequence are contiguous and in a sequential order.

An isolated polypeptide encoding for an edge portion of M78076_P17 (SEQ ID NO:174), comprising an amino acid sequence being at least 70%, optionally at least about 80%, preferably at least about 85%, more preferably at least about 90% and most preferably at least about 95% homologous to the sequence ECVCSKGFPFPLIGDSEG (SEQ I) NO:554) of M78076_P17 (SEQ ID NO:174).

An isolated chimeric polypeptide encoding for M78076_P17 (SEQ ID NO:174), comprising a first amino acid sequence being at least 90% homologous to amino acids 1-526 of NP_005157 (SEQ ID NO:167), which also corresponds to amino acids 1-526 of M78076_P17 (SEQ ID NO:174), and a second amino acid sequence being at least 70%, optionally at least 80%, preferably at least 85%, more preferably at least 90% and most preferably at least 95% homologous to a polypeptide having the sequence ECVCSKGFPFPLIGDSEG (SEQ ID NO:554) corresponding to amino acids 527-544 of M78076_P17 (SEQ ID NO:174), wherein said first amino acid sequence and second amino acid sequence are contiguous and in a sequential order.

An isolated polypeptide encoding for an edge portion of M78076_P17 (SEQ ID NO:174), comprising an amino acid sequence being at least 70%, optionally at least about 80%, preferably at least about 85%, more preferably at least about 90% and most preferably at least about 95% homologous to the sequence ECVCSKGFPFPLIGDSEG (SEQ ID NO:554) of M78076_P17 (SEQ ID NO:174).

An isolated chimeric polypeptide encoding for M78076_P22 (SEQ ID NO:175), comprising a first amino acid sequence being at least 90% homologous to amino acids 1-481 of APLP1_HUMAN (SEQ ID NO:591), which also corresponds to amino acids 1-481 of M78076_P22 (SEQ ID NO:175), and a second amino acid sequence being at least 70%, optionally at least 80%, preferably at least 85%, more preferably at least 90% and most preferably at least 95% homologous to a polypeptide having the sequence RECLLPWLPLQISEGRS (SEQ ID NO:555) corresponding to amino acids 482-498 of M78076_P22 (SEQ ID NO:175), wherein said first amino acid sequence and second amino acid sequence are contiguous and in a sequential order.

An isolated polypeptide encoding for an edge portion of M78076_P22 (SEQ ID NO:175), comprising an amino acid sequence being at least 70%, optionally at least about 80%, preferably at least about 85%, more preferably at least about 90% and most preferably at least about 95% homologous to the sequence RECLLPWLPLQISEGRS (SEQ ID NO:555) of M78076_P22 (SEQ ID NO:175).

An isolated chimeric polypeptide encoding for M78076_P22 (SEQ ID NO:175), comprising a first amino acid sequence being at least 90% homologous to amino acids 1-481 of NP_005157 (SEQ ID NO:167), which also corresponds to amino acids 1-481 of M78076_P22 (SEQ ID NO:175), and a second amino acid sequence being at least 70%, optionally at least 80%, preferably at least 85%, more preferably at least 90% and most preferably at least 95% homologous to a polypeptide having the sequence RECLLPWLPLQISEGRS (SEQ ID NO:555) corresponding to amino acids 482-498 of M78076_P22 (SEQ ID NO:175), wherein said first amino acid sequence and second amino acid sequence are contiguous and in a sequential order.

An isolated polypeptide encoding for an edge portion of M78076_P22 (SEQ ID NO:175), comprising an amino acid sequence being at least 70%, optionally at least about 80%, preferably at least about 85%, more preferably at least about 90% and most preferably at least about 95% homologous to the sequence RECLLPWLPLQISEGRS (SEQ ID NO:555) of M78076_P22 (SEQ ID NO:175).

An isolated chimeric polypeptide encoding for M78076_P23 (SEQ ID NO:176), comprising a first amino acid sequence being at least 90% homologous to amino acids 1-448 of APLP1_HUMAN (SEQ ID NO:591), which also corresponds to amino acids 1-448 of M78076_P23 (SEQ ID NO:176), and a second amino acid sequence being at least 70%, optionally at least 80%, preferably at least 85%, more preferably at least 90% and most preferably at least 95% homologous to a polypeptide having the sequence PQNPNSQPRAAGSLEVIISHPFVRRLEIL-ISPFQFQNSIPKNSQIVPAASPRGTSSP (SEQ ID NO:556) corresponding to amino acids 449-505 of M78076_P23 (SEQ ID NO:176), wherein said first amino acid sequence and second amino acid sequence are contiguous and in a sequential order.

An isolated polypeptide encoding for an edge portion of M78076_P23 (SEQ ID NO:176), comprising an amino acid sequence being at least 70%, optionally at least about 80%, preferably at least about 85%, more preferably at least about 90% and most preferably at least about 95% homologous to the sequence PQNPNSQPRAAGSLEVIISHPFVRRLEI-LISPFQFQNSIPKNSQIVPAASPRGTSSP (SEQ ID NO:556) of M78076_P23 (SEQ ID NO:176).

An isolated chimeric polypeptide encoding for M78076_P23 (SEQ ID NO:176), comprising a first amino acid sequence being at least 90% homologous to amino acids 1-448 of NP_005157 (SEQ ID NO:167), which also corresponds to amino acids 1-448 of M78076_P23 (SEQ ID NO:176), and a second amino acid sequence being at least 70%, optionally at least 80%, preferably at least 85%, more preferably at least 90% and most preferably at least 95% homologous to a polypeptide having the sequence PQNPNSQPRAAGSLEVIISHPFVRRLEIL-ISPFQFQNSIPKNSQIVPAASPRGTSSP (SEQ ID NO:556) corresponding to amino acids 449-505 of M78076_P23 (SEQ ID NO:176), wherein said first amino acid sequence and second amino acid sequence are contiguous and in a sequential order.

An isolated polypeptide encoding for an edge portion of M78076_P23 (SEQ ID NO:176), comprising an amino acid sequence being at least 70%, optionally at least about 80%, preferably at least about 85%, more preferably at least about 90% and most preferably at least about 95% homologous to the sequence PQNPNSQPRAAGSLEVIISHPFVRRLEI- LISPFQFQNSIPKNSQIVPAASPRGTSSP (SEQ ID NO:556) of M78076_P23 (SEQ ID NO:176).

An isolated chimeric polypeptide encoding for M78076_P25 (SEQ ID NO:177), comprising a first amino acid sequence being at least 90% homologous to amino acids 1-449 of APLP1_HUMAN (SEQ ID NO:591), which also corresponds to amino acids 1-449 of M78076_P25 (SEQ ID NO:177), and a second amino acid sequence being at least 70%, optionally at least 80%, preferably at least 85%, more preferably at least 90% and most preferably at least 95% homologous to a polypeptide having the sequence LTSFQLPNAPLFLRRPRLRLFSCPLDPLSVSWTPSYPLNTASLPLPSLSAQLPDPETWTLTCC VFDPCFLALGFLLPPPSILCSVPWIFTAFPRIVFFFFFFLRQVLALSPRQESSVRSWLIATSTS WVQAILLPQPLE (SEQ ID NO:557) corresponding to amino acids 450-588 of M78076_P25 (SEQ ID NO:177), wherein said first amino acid sequence and second amino acid sequence are contiguous and in a sequential order.

An isolated polypeptide encoding for an edge portion of M78076_P25 (SEQ ID NO:177), comprising an amino acid sequence being at least 70%, optionally at least about 80%, preferably at least about 85%, more preferably at least about 90% and most preferably at least about 95% homologous to the sequence LTSFQLPNAPLFLRRPRLRLFSCPLDPLSVSWTPSYPLNTASLPLPSLSAQLPDPETWTLTCC VFDPCFLALGFLLPPPSILCSVPWIFTAFPRIVFFFFFFLRQVLALSPRQESSVRSWLIATSTS WVQAILLPQPLE (SEQ ID NO:557) of M78076_P25 (SEQ ID NO:177).

An isolated chimeric polypeptide encoding for M78076_P25 (SEQ ID NO:177), comprising a first amino acid sequence being at least 90% homologous to amino acids 1-449 of NP_005157 (SEQ ID NO:167), which also corresponds to amino acids 1-449 of M78076_P25 (SEQ ID NO:177), and a second amino acid sequence being at least 70%, optionally at least 80%, preferably at least 85%, more preferably at least 90% and most preferably at least 95% homologous to a polypeptide having the sequence LTSFQLPNAPLFLRRPRLRLFSCPLDPLSVSWTPSYPLNTASLPLPSLSAQLPDPETWTLTCC VFDPCFLALGFLLPPPSILCSVPWIFTAFPRIVFFFFFFLRQVLALSPRQESSVRSWLIATSTS WVQAILLPQPLE (SEQ ID NO:557) corresponding to amino acids 450-588 of M78076_P25 (SEQ ID NO:177), wherein said first amino acid sequence and second amino acid sequence are contiguous and in a sequential order.

An isolated polypeptide encoding for an edge portion of M78076_P25 (SEQ ID NO:177), comprising an amino acid sequence being at least 70%, optionally at least about 80%, preferably at least about 85%, more preferably at least about 90% and most preferably at least about 95% homologous to the sequence LTSFQLPNAPLFLRRPRLRLFSCPLDPLSVSWTPSYPLNTASLPLPSLSAQLPDPETWTLTCC VFDPCFLALGFLLPPPSILCSVPWIFTAFPRIVFFFFFFLRQVLALSPRQESSVRSWLIATSTS WVQAILLPQPLE (SEQ ID NO:557) of M78076_P25 (SEQ ID NO:177).

An isolated chimeric polypeptide encoding for HSUPARAA_P1 (SEQ ID NO:226), comprising a first amino acid sequence being at least 90% homologous to amino acids 1-202 of UPAR_HUMAN (SEQ ID NO:593), which also corresponds to amino acids 1-202 of HSUPARAA_P1 (SEQ ID NO:226), and a second amino acid sequence being at least 70%, optionally at least 80%, preferably at least 85%, more preferably at least 90% and most preferably at least 95% homologous to a polypeptide having the sequence SKERETQSWSLKICRRMAASVTAARGTAPMDAPLKRLSSLTAEAP (SEQ ID NO:558) corresponding to amino acids 203-247 of HSUPARAA_P1 (SEQ ID NO:226), wherein said first amino acid sequence and second amino acid sequence are contiguous and in a sequential order.

An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence SKERETQSWSLKICRRMAASVTAARGTAPMDAPLKRLSSLTAEAP (SEQ ID NO:558) of HSUPARAA_P1 (SEQ ID NO:226).

An isolated chimeric polypeptide encoding for HSUPARAA_P1 (SEQ ID NO:226), comprising a first amino acid sequence being at least 90% homologous to amino acids 1-202 of Q9UPI5_HUMAN (SEQ ID NO:218), which also corresponds to amino acids 1-202 of HSUPARAA_P1 (SEQ ID NO:226), and a second amino acid sequence being at least 70%, optionally at least 80%, preferably at least 85%, more preferably at least 90% and most preferably at least 95% homologous to a polypeptide having the sequence SKERETQSWSLKICRRMAASVTAARGTAPMDAPLKRLSSLTAEAP (SEQ ID NO:558) corresponding to amino acids 203-247 of HSUPARAA_P1 (SEQ ID NO:226), wherein said first amino acid sequence and second amino acid sequence are contiguous and in a sequential order.

An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence SKERETQSWSLKICRRMAASVTAARGTAPMDAPLKRLSSLTAEAP (SEQ ID NO:558) of HSUPARAA_P1 (SEQ ID NO:226).

An isolated chimeric polypeptide encoding for HSUPARAA_P1 (SEQ ID NO:226), comprising a first amino acid sequence being at least 90% homologous to amino acids 1-202 of Q03405-2 (SEQ ID NO:219), which also corresponds to amino acids 1-202 of HSUPARAA_P1 (SEQ ID NO:226), and a second amino acid sequence being at least 70%, optionally at least 80%, preferably at least 85%, more preferably at least 90% and most preferably at least 95% homologous to a polypeptide having the sequence SKERETQSWSLKICRRMAASVTAARGTAPMDAPLKRLSSLTAEAP (SEQ ID NO:558) corresponding to amino acids 203-247 of HSUPARAA_P1 (SEQ ID NO:226), wherein said first amino acid sequence and second amino acid sequence are contiguous and in a sequential order.

An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence SKERETQSWSLKICRRMAASVTAARGTAPMDAPLKRLSSLTAEAP (SEQ ID NO:558) of HSUPARAA_P1 (SEQ ID NO:226).

An isolated chimeric polypeptide encoding for HSUPARAA_P1 (SEQ ID NO:226), comprising a first amino acid sequence being at least 90% homologous to amino acids 1-202 of NP_001005376 (SEQ ID NO:222), which also corresponds to amino acids 1-202 of HSUPARAA_P1 (SEQ ID NO:226), and a second amino acid sequence being at least 70%, optionally at least 80%, preferably at least 85%, more preferably at least 90% and most preferably at least 95% homologous to a polypeptide having the sequence SKERETQSWSLKICRRMAASVTAARG-TAPMDAPLKRLSSLTAEAP (SEQ ID NO:558) corresponding to amino acids 203-247 of HSUPARAA_P1 (SEQ ID NO:226), wherein said first amino acid sequence and second amino acid sequence are contiguous and in a sequential order.

An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence SKERETQSWSLKICRRMAAS-VTAARGTAPMDAPLKRLSSLTAEAP (SEQ ID NO:558) of HSUPARAA_P1 (SEQ ID NO:226).

An isolated chimeric polypeptide encoding for HSU-PARAA_P1 (SEQ ID NO:226), comprising a first amino acid sequence being at least 90% homologous to amino acids 1-164 of Q9BWT0_HUMAN (SEQ ID NO:223), which also corresponds to amino acids 1-164 of HSUPARAA_P1 (SEQ ID NO:226), a bridging amino acid H corresponding to amino acid 165 of HSUPARAA_P1 (SEQ ID NO:226), a second amino acid sequence being at least 90% homologous to amino acids 166-202 of Q9BWT0_HUMAN (SEQ ID NO:223), which also corresponds to amino acids 166-202 of HSUPARAA_P1 (SEQ ID NO:226), and a third amino acid sequence being at least 70%, optionally at least 80%, preferably at least 85%, more preferably at least 90% and most preferably at least 95% homologous to a polypeptide having the sequence SKERETQSWSLKICRRMAASVTAARG-TAPMDAPLKRLSSLTAEAP (SEQ ID NO:558) corresponding to amino acids 203-247 of HSUPARAA_P1 (SEQ ID NO:226), wherein said first amino acid sequence, bridging amino acid, second amino acid sequence and third amino acid sequence are contiguous and in a sequential order.

An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence SKERETQSWSLKICRRMAAS-VTAARGTAPMDAPLKRLSSLTAEAP (SEQ ID NO:558) of HSUPARAA_P1 (SEQ ID NO:226).

An isolated chimeric polypeptide encoding for HSU-PARAA_P1 (SEQ ID NO:226), comprising a first amino acid sequence being at least 90% homologous to amino acids 1-202 of NP_002650 (SEQ ID NO:217), which also corresponds to amino acids 1-202 of HSUPARAA_P1 (SEQ ID NO:226), and a second amino acid sequence being at least 70%, optionally at least 80%, preferably at least 85%, more preferably at least 90% and most preferably at least 95% homologous to a polypeptide having the sequence SKERETQSWSLKICRRMAASVTAARG-TAPMDAPLKRLSSLTAEAP (SEQ ID NO:558) corresponding to amino acids 203-247 of HSUPARAA_P1 (SEQ ID NO:226), wherein said first amino acid sequence and second amino acid sequence are contiguous and in a sequential order.

An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence SKERETQSWSLKICRRMAAS-VTAARGTAPMDAPLKRLSSLTAEAP (SEQ ID NO:558) of HSUPARAA_P1 (SEQ ID NO:226).

An isolated chimeric polypeptide encoding for HSU-PARAA_P1 (SEQ ID NO:226), comprising a first amino acid sequence being at least 90% homologous to amino acids 1-157 of NP_001005377 (SEQ ID NO:221), which also corresponds to amino acids 1-157 of HSUPARAA_P1 (SEQ ID NO:226), and a second amino acid sequence being at least 70%, optionally at least 80%, preferably at least 85%, more preferably at least 90% and most preferably at least 95% homologous to a polypeptide having the sequence GRPKD-DRHLRGCGYLPGCPGSNGFHNNDTFH-FLKCCNTTKCNEGPSKERETQSWSLKICR RMAAS-VTAARGTAPMDAPLKRLSSLTAEAP (SEQ ID NO:559) corresponding to amino acids 158-247 of HSUPARAA_P1 (SEQ ID NO:226), wherein said first amino acid sequence and second amino acid sequence are contiguous and in a sequential order.

An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKC-NEGPSKERETQSWSLKICR RMAASVTAARGTAPMDAPLKRLSSLTAEAP (SEQ ID NO:559) of HSUPARAA_P1 (SEQ ID NO:226).

An isolated chimeric polypeptide encoding for HSU-PARAA_P1 (SEQ ID NO:226), comprising a first amino acid sequence being at least 90% homologous to amino acids 1-157 of Q03405-3 (SEQ ID NO:220), which also corresponds to amino acids 1-157 of HSUPARAA_P1 (SEQ ID NO:226), and a second amino acid sequence being at least 70%, optionally at least 80%, preferably at least 85%, more preferably at least 90% and most preferably at least 95% homologous to a polypeptide having the sequence GRPKD-DRHLRGCGYLPGCPGSNGFHNNDTFH-FLKCCNTTKCNEGPSKERETQSWSLKICR RMAAS-VTAARGTAPMDAPLKRLSSLTAEAP (SEQ ID NO:559) corresponding to amino acids 158-247 of HSUPARAA_P1 (SEQ ID NO:226), wherein said first amino acid sequence and second amino acid sequence are contiguous and in a sequential order.

An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKC-NEGPSKERETQSWSLKICR RMAASVTAARGTAPMDAPLKRLSSLTAEAP (SEQ ID NO:559) of HSUPARAA_P1 (SEQ ID NO:226).

An isolated chimeric polypeptide encoding for HSU-PARAA_P2 (SEQ ID NO:227), comprising a first amino acid sequence being at least 90% homologous to amino acids 1-202 of UPAR_HUMAN (SEQ ID NO:593), which also corresponds to amino acids 1-202 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence SLLL-SPGA (SEQ ID NO:560) corresponding to amino acids 203-210 of HSUPARAA_P2 (SEQ ID NO:227), wherein said first amino acid sequence and second amino acid sequence are contiguous and in a sequential order.

An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence SLLLSPGA (SEQ ID NO:560) of HSUPARAA_P2 (SEQ ID NO:227).

An isolated chimeric polypeptide encoding for HSUPARAA_P2 (SEQ ID NO:227), comprising a first amino acid sequence being at least 90% homologous to amino acids 1-202 of Q9UPI5_HUMAN (SEQ ID NO:218), which also corresponds to amino acids 1-202 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence SLLLSPGA (SEQ ID NO:560) corresponding to amino acids 203-210 of HSUPARAA_P2 (SEQ ID NO:227), wherein said first amino acid sequence and second amino acid sequence are contiguous and in a sequential order.

An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence SLLLSPGA (SEQ ID NO:560) of HSUPARAA_P2 (SEQ ID NO:227).

An isolated chimeric polypeptide encoding for HSUPARAA_P2 (SEQ ID NO:227), comprising a first amino acid sequence being at least 90% homologous to amino acids 1-202 of Q03405-2 (SEQ ID NO:219), which also corresponds to amino acids 1-202 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence SLLLSPGA (SEQ ID NO:560) corresponding to amino acids 203-210 of HSUPARAA_P2 (SEQ ID NO:227), wherein said first amino acid sequence and second amino acid sequence are contiguous and in a sequential order.

An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence SLLLSPGA (SEQ ID NO:560) of HSUPARAA_P2 (SEQ ID NO:227).

An isolated chimeric polypeptide encoding for HSUPARAA_P2 (SEQ ID NO:227), comprising a first amino acid sequence being at least 90% homologous to amino acids 1-202 of NP_001005376 (SEQ ID NO:222), which also corresponds to amino acids 1-202 of HSUPARAA_P2 (SEQ ID NO:227), and a second amino acid sequence being at least 70%, optionally at least 80%, preferably at least 85%, more preferably at least 90% and most preferably at least 95% homologous to a polypeptide naving the sequence SLLLSPGA (SEQ ID NO:560) corresponding to amino acids 203-210 of HSUPARAA_P2 (SEQ ID NO:227), wherein said first amino acid sequence and second amino acid sequence are contiguous and in a sequential order.

An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence SLLLSPGA (SEQ ID NO:560) of HSUPARAA_P2 (SEQ ID NO:227).

An isolated chimeric polypeptide encoding for HSUPARAA_P2 (SEQ ID NO:227), comprising a first amino acid sequence being at least 90% homologous to amino acids 1-164 of Q9BWT0_HUMAN (SEQ ID NO:223), which also corresponds to amino acids 1-164 of HSUPARAA_P2 (SEQ ID NO:227), a bridging amino acid H corresponding to amino acid 165 of HSUPARAA_P2 (SEQ ID NO:227), a second amino acid sequence being at least 90% homologous to LRGCGYLPGCPGSNGFHNNDTFHFLKC-CNTTKCNEGP corresponding to amino acids 166-202 of Q9BWT0_HUMAN (SEQ ID NO:223), which also corresponds to amino acids 166-202 of HSUPARAA_P2 (SEQ ID NO:227), and a third amino acid sequence being at least 70%, optionally at least 80%, preferably at least 85%, more preferably at least 90% and most preferably at least 95% homologous to a polypeptide having the sequence SLLLSPGA (SEQ ID NO:560) corresponding to amino acids 203-210 of HSUPARAA_P2 (SEQ ID NO:227), wherein said first amino acid sequence, bridging amino acid, second amino acid sequence and third amino acid sequence are contiguous and in a sequential order.

An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence SLLLSPGA (SEQ ID NO:560) of HSUPARAA_P2 (SEQ ID NO:227).

An isolated chimeric polypeptide encoding for HSUPARAA_P2 (SEQ ID NO:227), comprising a first amino acid sequence being at least 90% homologous to amino acids 1-202 of NP_002650 (SEQ ID NO:217), which also corresponds to amino acids 1-202 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence SLLLSPGA (SEQ ID NO:560) corresponding to amino acids 203-210 of HSUPARAA_P2 (SEQ ID NO:227), wherein said first amino acid sequence and second amino acid sequence are contiguous and in a sequential order.

An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence SLLLSPGA (SEQ ID NO:560) of HSUPARAA_P2 (SEQ ID NO:227).

An isolated chimeric polypeptide encoding for HSUPARAA_P2 (SEQ ID NO:227), comprising a first amino acid sequence being at least 90% homologous to amino acids 1-157 of NP_001005377 (SEQ ID NO:221), which also corresponds to amino acids 1-157 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence GRPKD-DRHLRGCGYLPGCPGSNGFHNNDTFH-FLKCCNTTKCNEGPSLLLSPGA (SEQ ID NO:561) corresponding to amino acids 158-210 of HSUPARAA_P2 (SEQ ID NO:227), wherein said first amino acid sequence and second amino acid sequence are contiguous and in a sequential order.

An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG- FHNNDTFHFLKCCNTTKCNEGPSLLLSPGA (SEQ ID NO:561) of HSUPARAA_P2 (SEQ ID NO:227).

An isolated chimeric polypeptide encoding for HSU-PARAA_P2 (SEQ ID NO:227), comprising a first amino acid sequence being at least 90% homologous to amino acids 1-157 of Q03405-3 (SEQ ID NO:220), which also corresponds to amino acids 1-157 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence GRPKDDRHLRGCGYLPGCPGSNGFHNNDTFHFLKCCNTTKCNEGPSLLLSPGA (SEQ ID NO:561) corresponding to amino acids 158-210 of HSUPARAA_P2 (SEQ ID NO:227), wherein said first amino acid sequence and second amino acid sequence are contiguous and in a sequential order.

An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNGFHNNDTFHFLKCCNTTKCNEGPSLLLSPGA (SEQ ID NO:561) of HSUPARAA_P2 (SEQ ID NO:227).

An isolated chimeric polypeptide encoding for HSUPARAA_P7 (SEQ ID NO:228), comprising a first amino acid sequence being at least 90% homologous to amino acids 1-55 of UPAR_HUMAN (SEQ ID NO:593), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), and a third amino acid sequence being at least 90% homologous to amino acids 56-335 of UPAR_HUMAN (SEQ ID NO:593), which also corresponds to amino acids 61-340 of HSUPARAA P7 (SEQ ID NO:228), wherein said first amino acid sequence, second amino acid sequence and third amino acid sequence are contiguous and in a sequential order.

An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSUPARAA_P7 (SEQ ID NO:228).

An isolated chimeric polypeptide encoding for HSUPARAA_P7 (SEQ ID NO:228), comprising a first amino acid sequence being at least 90% homologous to amino acids 1-55 of NP_002650 (SEQ ID NO:217), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), and a third amino acid sequence being at least 90% homologous to amino acids 56-335 of NP_002650 (SEQ ID NO:217), which also corresponds to amino acids 61-340 of HSUPARAA_P7 (SEQ ID NO:228), wherein said first amino acid sequence, second amino acid sequence and third amino acid sequence are contiguous and in a sequential order.

An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSUPARAA_P7 (SEQ ID NO:228).

An isolated chimeric polypeptide encoding for HSUPARAA_P7 (SEQ ID NO:228), comprising a first amino acid sequence being at least 90% homologous to amino acids 1-55 of Q9BWT0_HUMAN (SEQ ID NO:223), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), a third amino acid sequence being at least 90% homologous to amino acids 56-164 of Q9BWT0_HUMAN (SEQ ID NO:223), which also corresponds to amino acids 61-169 of HSUPARAA_P7 (SEQ ID NO:228), a bridging amino acid H corresponding to amino acid 170 of HSUPARAA_P7 (SEQ ID NO:228), a fourth amino acid sequence being at least 90% homologous to amino acids 166-301 of Q9BWT0_HUMAN (SEQ ID NO:223), which also corresponds to amino acids 171-306 of HSUPARAA_P7 (SEQ ID NO:228), and a fifth amino acid sequence being at least 70%, optionally at least 80%, preferably at least 85%, more preferably at least 90% and most preferably at least 95% homologous to a polypeptide having the sequence YRSGAAPQPGPAHLSLTITLLMTARLWGGTLLWT (SEQ ID NO:563) corresponding to amino acids 307-340 of HSUPARAA_P7 (SEQ ID NO:228), wherein said first amino acid sequence, second amino acid sequence, third amino acid sequence, bridging amino acid, fourth amino acid sequence and fifth amino acid sequence are contiguous and in a sequential order.

An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSUPARAA_P7 (SEQ ID NO:228).

An isolated polypeptide encoding for a tail of HSUPARAA_P7 (SEQ ID NO:228), comprising a polypeptide being at least 70%, optionally at least about 80%, preferably at least about 85%, more preferably at least about 90% and most preferably at least about 95% homologous to the sequence YRSGAAPQPGPAHLSLTITLLMTARLWGGTLLWT (SEQ ID NO:563) of HSUPARAA_P7 (SEQ ID NO:228).

An isolated chimeric polypeptide encoding for HSUPARAA_P7 (SEQ ID NO:228), comprising a first amino acid sequence being at least 90% homologous to amino acids 1-55 of Q03405-3 (SEQ ID NO:220), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), a third amino acid sequence being at least 90% homologous to amino acids 56-157 of Q03405-3 (SEQ ID NO:220), which also corresponds to amino acids 61-162 of HSUPARAA_P7 (SEQ ID NO:228), a fourth amino acid sequence being at least 70%, optionally at least 80%, preferably at least 85%, more preferably at least 90% and most preferably at least 95% homologous to a polypeptide having the sequence GRPKDDRHLRGCGYLPGCPGSNGF-HNNDTFHFLKCCNTTKCNEGP (SEQ ID NO:564) corresponding to amino acids 163-207 of HSUPARAA_P7 (SEQ ID NO:228), and a fifth amino acid sequence being at least 90% homologous to amino acids 158-290 of Q03405-3 (SEQ ID NO:220), which also corresponds to amino acids 208-340 of HSUPARAA_P7 (SEQ ID NO:228), wherein said first amino acid sequence, second amino acid sequence, third amino acid sequence, fourth amino acid sequence and fifth amino acid sequence are contiguous and in a sequential order.

An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSU-PARAA_P7 (SEQ ID NO:228).

An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGP (SEQ ID NO:564) of HSUPARAA_P7 (SEQ ID NO:228).

An isolated chimeric polypeptide encoding for HSU-PARAA_P7 (SEQ ID NO:228), comprising a first amino acid sequence being at least 90% homologous to amino acids 1-55 of NP_001005377 (SEQ ID NO:221), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSU-PARAA_P7 (SEQ ID NO:228), a third amino acid sequence being at least 90% homologous to amino acids 56-157 of NP_001005377 (SEQ ID NO:221), which also corresponds to amino acids 61-162 of HSUPARAA_P7 (SEQ ID NO:228), a fourth amino acid sequence being at least 70%, optionally at least 80%, preferably at least 85%, more preferably at least 90% and most preferably at least 95% homologous to a polypeptide having the sequence GRPKDDRHL-RGCGYLPGCPGSNGFHNNDTFHFLKCCNTTKCNEGPI (SEQ ID NO:565) corresponding to amino acids 163-208 of HSUPARAA_P7 (SEQ ID NO:228), and a fifth amino acid sequence being at least 90% homologous to amino acids 159-290 of NP_001005377 (SEQ ID NO:221), which also corresponds to amino acids 209-340 of HSUPARAA_P7 (SEQ ID NO:228), wherein said first amino acid sequence, second amino acid sequence, third amino acid sequence, fourth amino acid sequence and fifth amino acid sequence are contiguous and in a sequential order.

An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSU-PARAA_P7 (SEQ ID NO:228).

An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGPI (SEQ ID NO:565) of HSUPARAA_P7 (SEQ ID NO:228).

A bridge portion of HSUPARAA_P7 (SEQ ID NO:228), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows (numbering according to HSU-PARAA_P7): a sequence starting from any of amino acid numbers 157-x to 157; and ending at any of amino acid numbers 158+((n−2)−x), in which x varies from 0 to n−2.

A bridge portion of HSUPARAA_P7 (SEQ ID NO:228), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IL, having a structure as follows (numbering according to HSU-PARAA_P7): a sequence starting from any of amino acid numbers 208-x to 208; and ending at any of amino acid numbers 209+((n−2)−x), in which x varies from 0 to n−2.

An isolated chimeric polypeptide encoding for HSU-PARAA_P7 (SEQ ID NO:228), comprising a first amino acid sequence being at least 90% homologous to amino acids 1-55 of Q9UPI5_HUMAN (SEQ ID NO:218), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSU-PARAA_P7 (SEQ ID NO:228), a third amino acid sequence being at least 90% homologous to amino acids 56-251 of Q9UP15_HUMAN (SEQ ID NO:218), which also corresponds to amino acids 61-256 of HSUPARAA_P7 (SEQ ID NO:228), and a fourth amino acid sequence being at least 70%, optionally at least 80%, preferably at least 85%, more preferably at least 90% and most preferably at least 95% homologous to a polypeptide having the sequence EPKN-QSYMVRGCATASMCQHAHLGDAFSMN-HIDVSCCTKSGCNHPDLDVQYRSGAAPQ PGPAHLSL-TITLLMTARLWGGTLLWT (SEQ ID NO:566) corresponding to amino acids 257-340 of HSUPARAA_P7 (SEQ ID NO:228), wherein said first amino acid sequence, second amino acid sequence, third amino acid sequence and fourth amino acid sequence are contiguous and in a sequential order.

An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSU-PARAA_P7 (SEQ ID NO:228).

An isolated polypeptide encoding for a tail of HSU-PARAA_P7 (SEQ ID NO:228), comprising a polypeptide being at least 70%, optionally at least about 80%, preferably at least about 85%, more preferably at least about 90% and most preferably at least about 95% homologous to the sequence EPKNQSYMVRGCATASMCQHAHLGDAF-SMNHIDVSCCTKSGCNHPDLDVQYRSGAAPQ PGPAHLSLTITLLMTARLWGGTLLWT (SEQ ID NO:566) of HSUPARAA_P7 (SEQ ID NO:228).

An isolated chimeric polypeptide encoding for HSU-PARAA_P7 (SEQ ID NO:228), comprising a first amino acid sequence being at least 90% homologous to amino acids 1-55 of NP_001005376 (SEQ ID NO:222), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSU-PARAA_P7 (SEQ ID NO:228), a third amino acid sequence being at least 90% homologous to amino acids 56-252 of NP_001005376 (SEQ ID NO:222), which also corresponds to amino acids 61-257 of HSUPARAA_P7 (SEQ ID NO:228), and a fourth amino acid sequence being at least 70%, optionally at least 80%, preferably at least 85%, more preferably at least 90% and most preferably at least 95% homologous to a polypeptide having the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) corresponding to amino acids 258-340 of HSUPARAA_P7 (SEQ ID NO:228), wherein said first amino acid sequence, second amino acid sequence, third amino acid sequence and fourth amino acid sequence are contiguous and in a sequential order.

An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSU-PARAA_P7 (SEQ ID NO:228).

An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) of HSUPARAA_P7 (SEQ ID NO:228).

An isolated chimeric polypeptide encoding for HSU-PARAA_P7 (SEQ ID NO:228), comprising a first amino acid sequence being at least 90% homologous to amino acids 1-55 of Q03405-2 (SEQ ID NO:219), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), a third amino acid sequence being at least 90% homologous to amino acids 56-252 of Q03405-2 (SEQ ID NO:219), which also corresponds to amino acids 61-257 of HSUPARAA_P7 (SEQ ID NO:228), and a fourth amino acid sequence being at least 70%, optionally at least 80%, preferably at least 85%, more preferably at least 90% and most preferably at least 95% homologous to a polypeptide having the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) corresponding to amino acids 258-340 of HSUPARAA_P7 (SEQ ID NO:228), wherein said first amino acid sequence, second amino acid sequence, third amino acid sequence and fourth amino acid sequence are contiguous and in a sequential order.

An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSU-PARAA_P7 (SEQ ID NO:228).

An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) of HSUPARAA_P7 (SEQ ID NO:228).

An isolated chimeric polypeptide encoding for HSU-PARAA_P8 (SEQ ID NO:229), comprising a first amino acid sequence being at least 90% homologous to amino acids 1-154 of UPAR_HUMAN (SEQ ID NO:593), which also corresponds to amino acids 1-154 of HSUPARAA_P8 (SEQ ID NO:229), and a second amino acid sequence being at least 90% homologous to amino acids 158-335 of UPAR_HUMAN (SEQ ID NO:593), which also corresponds to amino acids 155-332 of HSUPARAA_P8 (SEQ ID NO:229), wherein said first amino acid sequence and second amino acid sequence are contiguous and in a sequential order.

An isolated chimeric polypeptide encoding for an edge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 154-x to 154; and ending at any of amino acid numbers 155+((n−2)−x), in which x varies from 0 to n−2.

An isolated chimeric polypeptide encoding for HSU-PARAA_P8 (SEQ ID NO:229), comprising a first amino acid sequence being at least 90% homologous to amino acids 1-154 of NP_002650 (SEQ ID NO:217), which also corresponds to amino acids 1-154 of HSUPARAA_P8 (SEQ ID NO:229), and a second amino acid sequence being at least 90% homologous to amino acids 158-335 of NP_002650 (SEQ ID NO:217), which also corresponds to amino acids 155-332 of HSUPARAA_P8 (SEQ ID NO:229), wherein said first amino acid sequence and second amino acid sequence are contiguous and in a sequential order.

An isolated chimeric polypeptide encoding for an edge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 154-x to 154; and ending at any of amino acid numbers 155+((n−2)−x), in which x varies from 0 to n−2.

An isolated chimeric polypeptide encoding for HSU-PARAA_P8 (SEQ ID NO:229), comprising a first amino acid sequence being at least 90% homologous to amino acids 1-154 of Q9BWT0_HUMAN (SEQ ID NO:223), which also corresponds to amino acids 1-154 of HSUPARAA_P8 (SEQ ID NO:229), a second amino acid sequence being at least 90% homologous to GRPKDDR corresponding to amino acids 158-164 of Q9BWT0_HUMAN (SEQ ID NO:223), which also corresponds to amino acids 155-161 of HSUPARAA_P8 (SEQ ID NO:229), a bridging amino acid H corresponding to amino acid 162 of HSUPARAA_P8 (SEQ ID NO:229), a third amino acid sequence being at least 90% homologous to amino acids 166-301 of Q9BWT0_HUMAN (SEQ ID NO:223), which also corresponds to amino acids 163-298 of HSUPARAA_P8 (SEQ ID NO:229), and a fourth amino acid sequence being at least 70%, optionally at least 80%, preferably at least 85%, more preferably at least 90% and most preferably at least 95% homologous to a polypeptide having the sequence YRSGAAPQPGPAHLSLTITLLMTARLWGGTLLWT (SEQ ID NO:563) corresponding to amino acids 299-332 of HSUPARAA_P8 (SEQ ID NO:229), wherein said first amino acid sequence, second amino acid sequence, bridging amino acid, third amino acid sequence and fourth amino acid sequence are contiguous and in a sequential order.

An isolated chimeric polypeptide encoding for an edge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 154-x to 154; and ending at any of amino acid numbers 155+((n−2)−x), in which x varies from 0 to n−2.

An isolated polypeptide encoding for a tail of HSUPARAA_P8 (SEQ ID NO:229), comprising a polypeptide being at least 70%, optionally at least about 80%, preferably at least about 85%, more preferably at least about 90% and most preferably at least about 95% homologous to the sequence YRSGAAPQPGPAHLSLTITLLMTARLWGGTLLWT (SEQ ID NO:563) of HSUPARAA_P8 (SEQ ID NO:229).

An isolated chimeric polypeptide encoding for HSUPARAA_P8 (SEQ ID NO:229), comprising a first amino acid sequence being at least 90% homologous to amino acids 1-155 of Q03405-3 (SEQ ID NO:220), which also corresponds to amino acids 1-155 of HSUPARAA_P8 (SEQ ID NO:229), a second amino acid sequence being at least 70%, optionally at least 80%, preferably at least 85%, more preferably at least 90% and most preferably at least 95% homologous to a polypeptide having the sequence RPKDDRHLRGCGYLPGCPGSNGFHNNDTFHFLKCCNTTKCNEGP (SEQ ID NO:569) corresponding to amino acids 156-199 of HSUPARAA_P8 (SEQ ID NO:229), and a third amino acid sequence being at least 90% homologous to amino acids 158-290 of Q03405-3 (SEQ ID NO:220), which also corresponds to amino acids 200-332 of HSUPARAA_P8 (SEQ ID NO:229), wherein said first amino acid sequence, second amino acid sequence and third amino acid sequence are contiguous and in a sequential order.

An isolated polypeptide encoding for an edge portion of HSUPARAA_P8 (SEQ ID NO:229), comprising an amino acid sequence being at least 70%, optionally at least about 80%, preferably at least about 85%, more preferably at least about 90% and most preferably at least about 95% homologous to the sequence RPKDDRHLRGCGYLPGCPGSNGFHNNDTFHFLKCCNTTKCNEGP (SEQ ID NO:569) of HSUPARAA_P8 (SEQ ID NO:229).

A bridge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise GR, having a structure as follows (numbering according to HSUPARAA_P8): a sequence starting from any of amino acid numbers 155-x to 155; and ending at any of amino acid numbers 156+((n−2)−x), in which x varies from 0 to n−2.

A bridge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IL, having a structure as follows (numbering according to HSUPARAA_P8): a sequence starting from any of amino acid numbers 200-x to 200; and ending at any of amino acid numbers 201+((n−2)−x), in which x varies from 0 to n−2.

An isolated chimeric polypeptide encoding for HSUPARAA_P8 (SEQ ID NO:229), comprising a first amino acid sequence being at least 90% homologous to amino acids 1-155 of NP_001005377 (SEQ ID NO:221), which also corresponds to amino acids 1-155 of HSUPARAA_P8 (SEQ ID NO:229), a second amino acid sequence being at least 70%, optionally at least 80%, preferably at least 85%, more preferably at least 90% and most preferably at least 95% homologous to a polypeptide having the sequence RPKDDRHLRGCGYLPGCPGSNGFHNNDTFHFLKCCNTTKCNEGPI (SEQ ID NO:570) corresponding to amino acids 156-200 of HSUPARAA_P8 (SEQ ID NO:229), and a third amino acid sequence being at least 90% homologous to amino acids 159-290 of NP_001005377 (SEQ ID NO:221), which also corresponds to amino acids 201-332 of HSUPARAA_P8 (SEQ ID NO:229), wherein said first amino acid sequence, second amino acid sequence and third amino acid sequence are contiguous and in a sequential order.

An isolated polypeptide encoding for an edge portion of HSUPARAA_P8 (SEQ ID NO:229), comprising an amino acid sequence being at least 70%, optionally at least about 80%, preferably at least about 85%, more preferably at least about 90% and most preferably at least about 95% homologous to the sequence RPKDDRHLRGCGYLPGCPGSNGFHNNDTFHFLKCCNTTKCNEGPI (SEQ ID NO:570) of HSUPARAA_P8 (SEQ ID NO:229).

A bridge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise GR, having a structure as follows (numbering according to HSUPARAA_P8): a sequence starting from any of amino acid numbers 155-x to 155; and ending at any of amino acid numbers 156+((n−2)−x), in which x varies from 0 to n−2.

A bridge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IL, having a structure as follows (numbering according to HSUPARAA_P8): a sequence starting from any of amino acid numbers 200-x to 200; and ending at any of amino acid numbers 201+((n−2)−x), in which x varies from 0 to n−2.

An isolated chimeric polypeptide encoding for HSU-PARAA_P8 (SEQ ID NO:229), comprising a first amino acid sequence being at least 90% homologous to amino acids 1-154 of Q9UPI5_HUMAN (SEQ ID NO:218), which also corresponds to amino acids 1-154 of HSUPARAA_P8 (SEQ ID NO:229), a second amino acid sequence being at least 90% homologous to amino acids 158-251 of Q9UPI5_HUMAN (SEQ ID NO:218), which also corresponds to amino acids 155-248 of HSUPARAA_P8 (SEQ ID NO:229), and a third amino acid sequence being at least 70%, optionally at least 80%, preferably at least 85%, more preferably at least 90% and most preferably at least 95% homologous to a polypeptide having the sequence EPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:566) corresponding to amino acids 249-332 of HSUPARAA_P8 (SEQ ID NO:229), wherein said first amino acid sequence, second amino acid sequence and third amino acid sequence are contiguous and in a sequential order.

An isolated chimeric polypeptide encoding for an edge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 154-x to 154; and ending at any of amino acid numbers 155+((n−2)−x), in which x varies from 0 to n−2.

An isolated polypeptide encoding for a tail of HSUPARAA_P8 (SEQ ID NO:229), comprising a polypeptide being at least 70%, optionally at least about 80%, preferably at least about 85%, more preferably at least about 90% and most preferably at least about 95% homologous to the sequence EPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:566) of HSUPARAA_P8 (SEQ ID NO:229).

An isolated chimeric polypeptide encoding for HSUPARAA_P8 (SEQ ID NO:229), comprising a first amino acid sequence being at least 90% homologous to amino acids 1-154 of NP_001005376 (SEQ ID NO:222), which also corresponds to amino acids 1-154 of HSUPARAA_P8 (SEQ ID NO:229), a second amino acid sequence being at least 90% homologous to amino acids 158-252 of NP_001005376 (SEQ ID NO:222), which also corresponds to amino acids 155-249 of HSUPARAA_P8 (SEQ ID NO:229), and a third amino acid sequence being at least 70%, optionally at least 80%, preferably at least 85%, more preferably at least 90% and most preferably at least 95% homologous to a polypeptide having the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) corresponding to amino acids 250-332 of HSUPARAA_P8 (SEQ ID NO:229), wherein said first amino acid sequence, second amino acid sequence and third amino acid sequence are contiguous and in a sequential order.

An isolated chimeric polypeptide encoding for an edge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 154-x to 154; and ending at any of amino acid numbers 155+((n−2)−x), in which x varies from 0 to n−2.

An isolated polypeptide encoding for an edge portion of HSUPARAA_P8 (SEQ ID NO:229), comprising an amino acid sequence being at least 70%, optionally at least about 80%, preferably at least about 85%, more preferably at least about 90% and most preferably at least about 95% homologous to the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) of HSUPARAA_P8 (SEQ ID NO:229).

An isolated chimeric polypeptide encoding for HSUPARAA P8 (SEQ ID NO:229), comprising a first amino acid sequence being at least 90% homologous to amino acids 1-154 of Q03405-2 (SEQ ID NO:219), which also corresponds to amino acids 1-154 of HSUPARAA_P8 (SEQ ID NO:229), a second amino acid sequence being at least 90% homologous to amino acids 158-252 of Q03405-2 (SEQ ID NO:219), which also corresponds to amino acids 155-249 of HSUPARAA_P8 (SEQ ID NO:229), and a third amino acid sequence being at least 70%, optionally at least 80%, preferably at least 85%, more preferably at least 90% and most preferably at least 95% homologous to a polypeptide having the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) corresponding to amino acids 250-332 of HSUPARAA_P8 (SEQ ID NO:229), wherein said first amino acid sequence, second amino acid sequence and third amino acid sequence are contiguous and in a sequential order.

An isolated chimeric polypeptide encoding for an edge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 154-x to 154; and ending at any of amino acid numbers 155+((n−2)−x), in which x varies from 0 to n−2.

An isolated polypeptide encoding for an edge portion of HSUPARAA_P8 (SEQ ID NO:229), comprising an amino acid sequence being at least 70%, optionally at least about 80%, preferably at least about 85%, more preferably at least about 90% and most preferably at least about 95% homologous to the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) of HSUPARAA_P8 (SEQ ID NO:229).

An isolated chimeric polypeptide encoding for HSUPARAA_P11 (SEQ ID NO:230), comprising a first amino acid sequence being at least 90% homologous to amino acids 1-252 of UPAR_HUMAN (SEQ ID NO:593), which also corresponds to amino acids 1-252 of HSUPARAA_P11 (SEQ ID NO:230), and a second amino acid sequence being at least 70%, optionally at least 80%, preferably at least 85%, more preferably at least 90% and most preferably at least 95% homologous to a polypeptide having the sequence RSLWGSWLPCKSTTALRPPCCEEAQATHV (SEQ ID NO:573) corresponding to amino acids 253-281 of HSUPARAA_P11 (SEQ ID NO:230), wherein said first amino acid sequence and second amino acid sequence are contiguous and in a sequential order.

An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence RSLWGSWLPCKSTTALRPPCCEE-AQATHV (SEQ ID NO:573) of HSUPARAA_P11 (SEQ ID NO:230).

An isolated chimeric polypeptide encoding for HSU-PARAA_P11 (SEQ ID NO:230), comprising a first amino acid sequence being at least 90% homologous to amino acids 1-251 of Q9UPI5_HUMAN (SEQ ID NO:218), which also corresponds to amino acids 1-251 of HSUPARAA_P11 (SEQ ID NO:230), and a second amino acid sequence being at least 70%, optionally at least 80%, preferably at least 85%, more preferably at least 90% and most preferably at least 95% homologous to a polypeptide having the sequence ERSLWG-SWLPCKSTTALRPPCCEEAQATHV (SEQ ID NO:574) corresponding to amino acids 252-281 of HSUPARAA_P11 (SEQ ID NO:230), wherein said first amino acid sequence and second amino acid sequence are contiguous and in a sequential order.

An isolated polypeptide encoding for a tail of HSU-PARAA_P11 (SEQ ID NO:230), comprising a polypeptide being at least 70%, optionally at least about 80%, preferably at least about 85%, more preferably at least about 90% and most preferably at least about 95% homologous to the sequence ERSLWGSWLPCKSTTALRPPCCEEAQATHV (SEQ ID NO:574) of HSUPARAA_P11 (SEQ ID NO:230).

An isolated chimeric polypeptide encoding for HSU-PARAA P11 (SEQ ID NO:230), comprising a first amino acid sequence being at least 90% homologous to amino acids 1-164 of Q9BWT0_HUMAN (SEQ ID NO:223), which also corresponds to amino acids 1-164 of HSUPARAA_P11 (SEQ ID NO:230), a bridging amino acid H corresponding to amino acid 165 of HSUPARAA_P11 (SEQ ID NO:230), a second amino acid sequence being at least 90% homologous to amino acids 166-252 of Q9BWT0_HUMAN (SEQ ID NO:223), which also corresponds to amino acids 166-252 of HSUPARAA_P11 (SEQ ID NO:230), and a third amino acid sequence being at least 70%, optionally at least 80%, preferably at least 85%, more preferably at least 90% and most preferably at least 95% homologous to a polypeptide having the sequence RSLWGSWLPCKSTTALRPPCCEE-AQATHV (SEQ ID NO:573) corresponding to amino acids 253-281 of HSUPARAA_P11 (SEQ ID NO:230), wherein said first amino acid sequence, bridging amino acid, second amino acid sequence and third amino acid sequence are contiguous and in a sequential order.

An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence RSLWGSWLPCKSTTALRPPCCEE-AQATHV (SEQ ID NO:573) of HSUPARAA_P11 (SEQ ID NO:230).

An isolated chimeric polypeptide encoding for HSU-PARAA_P11 (SEQ ID NO:230), comprising a first amino acid sequence being at least 90% homologous to amino acids 1-252 of NP_002650 (SEQ ID NO:217), which also corresponds to amino acids 1-252 of HSUPARAA_P11 (SEQ ID NO:230), and a second amino acid sequence being at least 70%, optionally at least 80%, preferably at least 85%, more preferably at least 90% and most preferably at least 95% homologous to a polypeptide having the sequence RSLWG-SWLPCKSTTALRPPCCEEAQATHV (SEQ ID NO:573) corresponding to amino acids 253-281 of HSUPARAA_P11 (SEQ ID NO:230), wherein said first amino acid sequence and second amino acid sequence are contiguous and in a sequential order.

An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence RSLWGSWLPCKSTTALRPPCCEE-AQATHV (SEQ ID NO:573) of HSUPARAA_P11 (SEQ ID NO:230).

An isolated chimeric polypeptide encoding for HSU-PARAA_P11 (SEQ ID NO:230), comprising a first amino acid sequence being at least 90% homologous to amino acids 1-157 of Q03405-3 (SEQ ID NO:220), which also corresponds to amino acids 1-157 of HSUPARAA_P11 (SEQ ID NO:230), a second amino acid sequence being at least 70%, optionally at least 80%, preferably at least 85%, more preferably at least 90% and most preferably at least 95% homologous to a polypeptide having the sequence GRPKDDRHL-RGCGYLPGCPGSNGFHNNDTFHFLKCCNTTKCNEGP (SEQ ID NO:564) corresponding to amino acids 158-202 of HSUPARAA_P11 (SEQ ID NO:230), a third amino acid sequence being at least 90% homologous to amino acids 158-207 of Q03405-3 (SEQ ID NO:220), which also corresponds to amino acids 203-252 of HSUPARAA_P11 (SEQ ID NO:230), and a fourth amino acid sequence being at least 70%, optionally at least 80%, preferably at least 85%, more preferably at least 90% and most preferably at least 95% homologous to a polypeptide having the sequence RSLWG-SWLPCKSTTALRPPCCEEAQATHV (SEQ ID NO:573) corresponding to amino acids 253-281 of HSUPARAA_P11 (SEQ ID NO:230), wherein said first amino acid sequence, second amino acid sequence, third amino acid sequence and fourth amino acid sequence are contiguous and in a sequential order.

An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGP (SEQ ID NO:564) of HSUPARAA_P11 (SEQ ID NO:230).

An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence RSLWGSWLPCKSTTALRPPCCEE-AQATHV (SEQ ID NO:573) of HSUPARAA_P11 (SEQ ID NO:230).

An isolated chimeric polypeptide encoding for HSU-PARAA_P11 (SEQ ID NO:230), comprising a first amino acid sequence being at least 90% homologous to amino acids 1-157 of NP_001005377 (SEQ ID NO:221), which also corresponds to amino acids 1-157 of HSUPARAA_P11 (SEQ ID NO:230), a second amino acid sequence being at least 70%, optionally at least 80%, preferably at least 85%, more preferably at least 90% and most preferably at least 95% homologous to a polypeptide having the sequence GRPKD-DRHLRGCGYLPGCPGSNGFHNNDTFH-FLKCCNTTKCNEGPI (SEQ ID NO:565) corresponding to amino acids 158-203 of HSUPARAA_P11 (SEQ ID NO:230), a third amino acid sequence being at least 90% homologous to amino acids 159-207 of NP_001005377

(SEQ ID NO:221), which also corresponds to amino acids 204-252 of HSUPARAA_P11 (SEQ ID NO:230), and a fourth amino acid sequence being at least 70%, optionally at least 80%, preferably at least 85%, more preferably at least 90% and most preferably at least 95% homologous to a polypeptide having the sequence RSLWGSWLPCKSTTAL-RPPCCEEAQATHV (SEQ ID NO:573) corresponding to amino acids 253-281 of HSUPARAA_P11 (SEQ ID NO:230), wherein said first amino acid sequence, second amino acid sequence, third amino acid sequence and fourth amino acid sequence are contiguous and in a sequential order.

An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGPI (SEQ ID NO:565) of HSUPARAA_P11 (SEQ ID NO:230).

A bridge portion of HSUPARAA_P11 (SEQ ID NO:230), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows (numbering according to HSUPARAA_P11): a sequence starting from any of amino acid numbers 157-x to 157; and ending at any of amino acid numbers 158+((n−2)−x), in which x varies from 0 to n−2.

A bridge portion of HSUPARAA_P11 (SEQ ID NO:230), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IL, having a structure as follows (numbering according to HSUPARAA_P11): a sequence starting from any of amino acid numbers 203-x to 203; and ending at any of amino acid numbers 204+((n−2)−x), in which x varies from 0 to n−2.

An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence RSLWGSWLPCKSTTALRPPCCEE-AQATHV (SEQ ID NO:573) of HSUPARAA_P11 (SEQ ID NO:230).

An isolated chimeric polypeptide encoding for HSUPARAA_P13 (SEQ ID NO:231), comprising a first amino acid sequence being at least 90% homologous to amino acids 1-251 of UPAR_HUMAN (SEQ ID NO:593)_V1 (SEQ ID NO:225), which also corresponds to amino acids 1-251 of HSUPARAA_P13 (SEQ ID NO:231), and a second amino acid sequence being at least 70%, optionally at least 80%, preferably at least 85%, more preferably at least 90% and most preferably at least 95% homologous to a polypeptide having the sequence GCGHFCHGKVEFRLGAVAEACTL-STLGG (SEQ ID NO:577) corresponding to amino acids 252-279 of HSUPARAA_P13 (SEQ ID NO:231), wherein said first amino acid sequence and second amino acid sequence are contiguous and in a sequential order.

An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTL-STLGG (SEQ ID NO:577) of HSUPARAA_P13 (SEQ ID NO:231).

An isolated chimeric polypeptide encoding for HSUPARAA_P13 (SEQ ID NO:231), comprising a first amino acid sequence being at least 90% homologous to amino acids 1-251 of Q9UPI5_HUMAN (SEQ ID NO:218), which also corresponds to amino acids 1-251 of HSUPARAA_P13 (SEQ ID NO:231), and a second amino acid sequence being at least 70%, optionally at least 80%, preferably at least 85%, more preferably at least 90% and most preferably at least 95% homologous to a polypeptide having the sequence GCGH-FCHGKVEFRLGAVAEACTLSTLGG (SEQ ID NO:577) corresponding to amino acids 252-279 of HSUPARAA_P13 (SEQ ID NO:231), wherein said first amino acid sequence and second amino acid sequence are contiguous and in a sequential order.

An isolated polypeptide encoding for a tail of HSUPARAA_P13 (SEQ ID NO:231), comprising a polypeptide being at least 70%, optionally at least about 80%, preferably at least about 85%, more preferably at least about 90% and most preferably at least about 95% homologous to the sequence GCGHFCHGKVEFRLGAVAEACTLSTLGG (SEQ ID NO:577) of HSUPARAA_P13 (SEQ ID NO:231).

An isolated chimeric polypeptide encoding for HSUPARAA_P13 (SEQ ID NO:231), comprising a first amino acid sequence being at least 90% homologous to amino acids 1-251 of Q03405-2 (SEQ ID NO:219), which also corresponds to amino acids 1-251 of HSUPARAA_P13 (SEQ ID NO:231), and a second amino acid sequence being at least 70%, optionally at least 80%, preferably at least 85%, more preferably at least 90% and most preferably at least 95% homologous to a polypeptide having the sequence GCGH-FCHGKVEFRLGAVAEACTLSTLGG (SEQ ID NO:577) corresponding to amino acids 252-279 of HSUPARAA_P13 (SEQ ID NO:23 1), wherein said first amino acid sequence and second amino acid sequence are contiguous and in a sequential order.

An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTL-STLGG (SEQ ID NO:577) of HSUPARAA_P13 (SEQ ID NO:231).

An isolated chimeric polypeptide encoding for HSUPARAA_P13 (SEQ ID NO:231), comprising a first amino acid sequence being at least 90% homologous to amino acids 1-251 of NP_001005376 (SEQ ID NO:222), which also corresponds to amino acids 1-251 of HSUPARAA_P13 (SEQ ID NO:231), and a second amino acid sequence being at least 70%, optionally at least 80%, preferably at least 85%, more preferably at least 90% and most preferably at least 95% homologous to a polypeptide having the sequence GCGH-FCHGKVEFRLGAVAEACTLSTLGG (SEQ ID NO:577) corresponding to amino acids 252-279 of HSUPARAA_P13 (SEQ ID NO:231), wherein said first amino acid sequence and second amino acid sequence are contiguous and in a sequential order.

An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTLSTLGG (SEQ ID NO:577) of HSUPARAA_P13 (SEQ ID NO:231).

An isolated chimeric polypeptide encoding for HSUPARAA_P13 (SEQ ID NO:231), comprising a first amino acid sequence being at least 90% homologous to amino acids 1-164 of Q9BWT0_HUMAN (SEQ ID NO:223), which also corresponds to amino acids 1-164 of HSUPARAA_P13 (SEQ ID NO:231), a bridging amino acid H corresponding to amino acid 165 of HSUPARAA_P13 (SEQ ID NO:231), a second amino acid sequence being at least 90% homologous to amino acids 166-251 of Q9BWT0_HUMAN (SEQ ID NO:223), which also corresponds to amino acids 166-251 of HSUPARAA_P13 (SEQ ID NO:231), and a third amino acid sequence being at least 70%, optionally at least 80%, preferably at least 85%, more preferably at least 90% and most preferably at least 95% homologous to a polypeptide having the sequence GCGHFCHGKVEFRLGAVAEACTLSTLGG (SEQ ID NO:577) corresponding to amino acids 252-279 of HSUPARAA_P13 (SEQ ID NO:231), wherein said first amino acid sequence, bridging amino acid, second amino acid sequence and third amino acid sequence are contiguous and in a sequential order.

An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTLSTLGG (SEQ ID NO:577) of HSUPARAA_P13 (SEQ ID NO:231).

An isolated chimeric polypeptide encoding for HSUPARAA_P13 (SEQ ID NO:231), comprising a first amino acid sequence being at least 90% homologous to amino acids 1-251 of NP_002650_V1 (SEQ ID NO:224), which also corresponds to amino acids 1-251 of HSUPARAA_P13 (SEQ ID NO:231), and a second amino acid sequence being at least 70%, optionally at least 80%, preferably at least 85%, more preferably at least 90% and most preferably at least 95% homologous to a polypeptide having the sequence GCGHFCHGKVEFRLGAVAEACTLSTLGG (SEQ ID NO:577) corresponding to amino acids 252-279 of HSUPARAA_P13 (SEQ ID NO:231), wherein said first amino acid sequence and second amino acid sequence are contiguous and in a sequential order.

An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTLSTLGG (SEQ ID NO:577) of HSUPARAA_P13 (SEQ ID NO:231).

An isolated chimeric polypeptide encoding for HSUPARAA_P13 (SEQ ID NO:231), comprising a first amino acid sequence being at least 90% homologous to sequence corresponding to amino acids 1-157 of Q03405-3 (SEQ ID NO:220), which also corresponds to amino acids 1-157 of HSUPARAA_P13 (SEQ ID NO:231), a second amino acid sequence being at least 70%, optionally at least 80%, preferably at least 85%, more preferably at least 90% and most preferably at least 95% homologous to a polypeptide having the sequence GRPKDDRHLRGCGYLPGCPGSNGFHNNDTFHFLKCCNTTKCNEGP (SEQ ID NO:564) corresponding to amino acids 158-202 of HSUPARAA_P13 (SEQ ID NO:231), a third amino acid sequence being at least 90% homologous to amino acids 158-206 of Q03405-3 (SEQ ID NO:220), which also corresponds to amino acids 203-251 of HSUPARAA_P13 (SEQ ID NO:231), and a fourth amino acid sequence being at least 70%, optionally at least 80%, preferably at least 85%, more preferably at least 90% and most preferably at least 95% homologous to a polypeptide having the sequence GCGHFCHGKVEFRLGAVAEACTLSTLGG (SEQ ID NO:577) corresponding to amino acids 252-279 of HSUPARAA_P13 (SEQ ID NO:231), wherein said first amino acid sequence, second amino acid sequence, third amino acid sequence and fourth amino acid sequence are contiguous and in a sequential order.

An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNGFHNNDTFHFLKCCNTTKCNEGP (SEQ ID NO:564) of HSUPARAA_P13 (SEQ ID NO:231).

An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTLSTLGG (SEQ ID NO:577) of HSUPARAA_P13 (SEQ ID NO:231).

An isolated chimeric polypeptide encoding for HSUPARAA_P13 (SEQ ID NO:231), comprising a first amino acid sequence being at least 90% homologous to amino acids 1-157 of NP_001005377 (SEQ ID NO:221), which also corresponds to amino acids 1-157 of HSUPARAA_P13 (SEQ ID NO:231), a second amino acid sequence being at least 70%, optionally at least 80%, preferably at least 85%, more preferably at least 90% and most preferably at least 95% homologous to a polypeptide having the sequence GRPKDDRHLRGCGYLPGCPGSNGFHNNDTFHFLKCCNTTKCNEGPI (SEQ ID NO:565) corresponding to amino acids 158-203 of HSUPARAA_P13 (SEQ ID NO:231), a third amino acid sequence being at least 90% homologous to amino acids 159-206 of NP_001005377 (SEQ ID NO:221), which also corresponds to amino acids 204-251 of HSUPARAA_P13 (SEQ ID NO:231), and a fourth amino acid sequence being at least 70%, optionally at least 80%, preferably at least 85%, more preferably at least 90% and most preferably at least 95% homologous to a polypeptide having the sequence GCGHFCHGKVEFRLGAVAEACTLSTLGG (SEQ ID NO:577) corresponding to amino acids 252-279 of HSUPARAA_P13 (SEQ ID NO:231), wherein said first amino acid sequence, second amino acid sequence, third amino acid sequence and fourth amino acid sequence are contiguous and in a sequential order.

An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNGFHNNDTFHFLKCCNTTKCNEGPI (SEQ ID NO:565) of HSUPARAA_P13 (SEQ ID NO:231).

A bridge portion of HSUPARAA_P13 (SEQ ID NO:231), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows (numbering according to HSU-PARAA_P13): a sequence starting from any of amino acid numbers 157-x to 157; and ending at any of amino acid numbers 158+((n−2)−x), in which x varies from 0 to n−2.

A bridge portion of HSUPARAA_P13 (SEQ ID NO:231), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IL, having a structure as follows (numbering according to HSU-PARAA_P13): a sequence starting from any of amino acid numbers 203-x to 203; and ending at any of amino acid numbers 204+((n−2)−x), in which x varies from 0 to n−2.

An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTLSTLGG (SEQ ID NO:577) of HSUPARAA_P13 (SEQ ID NO:231).

An isolated chimeric polypeptide encoding for HSUPARAA_P14 (SEQ ID NO:232), comprising a first amino acid sequence being at least 90% homologous to amino acids 1-202 of UPAR_HUMAN (SEQ ID NO:593), which also corresponds to amino acids 1-202 of HSUPARAA_P14 (SEQ ID NO:232), a second bridging amino acid sequence comprising of K, and a third amino acid sequence being at least 90% homologous to amino acids 253-335 of UPAR_HUMAN (SEQ ID NO:593), which also corresponds to amino acids 204-286 of HSUPARAA_P14 (SEQ ID NO:232), wherein said first amino acid sequence, second amino acid sequence and third amino acid sequence are contiguous and in a sequential order.

An isolated polypeptide encoding for an edge portion of HSUPARAA_P14 (SEQ ID NO:232), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PK having a structure as follows (numbering according to HSUPARAA_P14): a sequence starting from any of amino acid numbers 202-x to 202; and ending at any of amino acid numbers 203+((n−2)−x), in which x varies from 0 to n−2.

An isolated polypeptide encoding for an edge portion of HSUPARAA_P14 (SEQ ID NO:232), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KP having a structure as follows (numbering according to HSUPARAA_P14): a sequence starting from any of amino acid numbers 203-x to 203; and ending at any of amino acid numbers 204+((n−2)−x), in which x varies from 0 to n−2.

An isolated chimeric polypeptide encoding for HSUPARAA_P14 (SEQ ID NO:232), comprising a first amino acid sequence being at least 90% homologous to amino acids 1-202 of NP_002650 (SEQ ID NO:217), which also corresponds to amino acids 1-202 of HSUPARAA_P14 (SEQ ID NO:232), a second bridging amino acid sequence comprising of K, and a third amino acid sequence being at least 90% homologous to amino acids 253-335 of NP_002650 (SEQ ID NO:217), which also corresponds to amino acids 204-286 of HSUPARAA_P14 (SEQ ID NO:232), wherein said first amino acid sequence, second amino acid sequence and third amino acid sequence are contiguous and in a sequential order.

An isolated polypeptide encoding for an edge portion of HSUPARAA_P14 (SEQ ID NO:232), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PK having a structure as follows (numbering according to HSUPARAA_P14): a sequence starting from any of amino acid numbers 202-x to 202; and ending at any of amino acid numbers 203+((n−2)−x), in which x varies from 0 to n−2.

An isolated polypeptide encoding for an edge portion of HSUPARAA_P14 (SEQ ID NO:232), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KP having a structure as follows (numbering according to HSUPARAA_P14): a sequence starting from any of amino acid numbers 203-x to 203; and ending at any of amino acid numbers 204+((n−2)−x), in which x varies from 0 to n−2.

An isolated chimeric polypeptide encoding for HSUPARAA_P14 (SEQ ID NO:232), comprising a first amino acid sequence being at least 90% homologous to amino acids 1-164 of Q9BWT0_HUMAN (SEQ ID NO:223), which also corresponds to amino acids 1-164 of HSUPARAA_P14 (SEQ ID NO:232), a bridging amino acid H corresponding to amino acid 165 of HSUPARAA_P14 (SEQ ID NO:232), a second amino acid sequence being at least 90% homologous to amino acids 166-202 of Q9BWT0_HUMAN (SEQ ID NO:223), which also corresponds to amino acids 166-202 of HSUPARAA_P14 (SEQ ID NO:232), a third bridging amino acid sequence comprising of K, a fourth amino acid sequence being at least 90% homologous to amino acids 253-301 of Q9BWT0_HUMAN (SEQ ID NO:223), which also corresponds to amino acids 204-252 of HSUPARAA_P14 (SEQ ID NO:232), and a fifth amino acid sequence being at least 70%, optionally at least 80%, preferably at least 85%, more preferably at least 90% and most preferably at least 95% homologous to a polypeptide having the sequence YRSGAAPQPGPAHLSLTITLLMTARLWGGTLLWT (SEQ ID NO:563) corresponding to amino acids 253-286 of HSUPARAA_P14 (SEQ ID NO:232), wherein said first amino acid sequence, bridging amino acid, second amino acid sequence, third amino acid sequence, fourth amino acid sequence and fifth amino acid sequence are contiguous and in a sequential order.

An isolated polypeptide encoding for an edge portion of HSUPARAA_P14 (SEQ ID NO:232), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PK having a structure as follows (numbering according to HSUPARAA_P14): a sequence starting from any of amino acid numbers 202-x to 202; and ending at any of amino acid numbers 203+((n−2)−x), in which x varies from 0 to n−2.

An isolated polypeptide encoding for an edge portion of HSUPARAA_P14 (SEQ ID NO:232), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KP having a structure as follows (numbering according to HSUPARAA_P14): a sequence starting from any of amino acid numbers 203-x to 203; and ending at any of amino acid numbers 204+((n−2)−x), in which x varies from 0 to n−2.

An isolated polypeptide encoding for a tail of HSUPARAA_P14 (SEQ ID NO:232), comprising a polypeptide being at least 70%, optionally at least about 80%, preferably at least about 85%, more preferably at least about 90% and most preferably at least about 95% homologous to the sequence YRSGAAPQPGPAHLSLTITLLMTARLWGGTLLWT (SEQ ID NO:563) of HSUPARAA_P14 (SEQ ID NO:232).

An isolated chimeric polypeptide encoding for HSUPARAA_P14 (SEQ ID NO:232), comprising a first amino acid sequence being at least 90% homologous to amino acids 1-157 of Q03405-3 (SEQ ID NO:220), which also corresponds to amino acids 1-157 of HSUPARAA_P14 (SEQ ID NO:232), a second amino acid sequence being at least 70%, optionally at least 80%, preferably at least 85%, more preferably at least 90% and most preferably at least 95%, homologous to a polypeptide having the sequence GRPKDDRHLRGCGYLPGCPGSNGFHNNDTFHFLKCCNTTKCNEGPK (SEQ ID NO:604) corresponding to amino acids 158-203 of HSUPARAA_P14 (SEQ ID NO:232), and a third amino acid sequence being at least 90% homologous amino acids 208-290 of Q03405-3 (SEQ ID NO:220), which also corresponds to amino acids 204-286 of HSUPARAA_P14 (SEQ ID NO:232), wherein said first amino acid sequence, second amino acid sequence and third amino acid sequence are contiguous and in a sequential order.

An isolated chimeric polypeptide encoding for HSUPARAA_P14 (SEQ ID NO:232), comprising a first amino acid sequence being at least 90% homologous to amino acids 1-157 of NP_001005377 (SEQ ID NO:221), which also corresponds to amino acids 1-157 of HSUPARAA_P14 (SEQ ID NO:232), a second amino acid sequence being at least 70%, optionally at least 80%, preferably at least 85%, more preferably at least 90% and most preferably at least 95%, homologous to a polypeptide having the sequence GRPKDDRHLRGCGYLPGCPGSNGFHNNDTFHFLKCCNTTKCNEGPK (SEQ ID NO:604) corresponding to amino acids 158-203 of HSUPARAA_P14 (SEQ ID NO:232), and a third amino acid sequence being at least 90% homologous to amino acids 208-290 of NP_001005377 (SEQ ID NO:221), which also corresponds to amino acids 204-286 of HSUPARAA_P14 (SEQ ID NO:232), wherein said first amino acid sequence, second amino acid sequence and third amino acid sequence are contiguous and in a sequential order.

An isolated chimeric polypeptide encoding for HSUPARAA_P14 (SEQ ID NO:232), comprising a first amino acid sequence being at least 90% homologous to amino acids 1-202 of Q9UPI5_HUMAN (SEQ ID NO:218), which also corresponds to amino acids 1-202 of HSUPARAA_P14 (SEQ ID NO:232), and a second amino acid sequence being at least 70%, optionally at least 80%, preferably at least 85%, more preferably at least 90% and most preferably at least 95% homologous to a polypeptide having the sequence KPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:582) corresponding to amino acids 203-286 of HSUPARAA_P14 (SEQ ID NO:232), wherein said first amino acid sequence and second amino acid sequence are contiguous and in a sequential order.

An isolated polypeptide encoding for an edge portion of HSUPARAA_P14 (SEQ ID NO:232), comprising an amino acid sequence being at least 70%, optionally at least about 80%, preferably at least about 85%, more preferably at least about 90% and most preferably at least about 95% homologous to the sequence KPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:582) of HSUPARAA_P14 (SEQ ID NO:232).

An isolated chimeric polypeptide encoding for HSUPARAA_P14 (SEQ ID NO:232), comprising a first amino acid sequence being at least 90% homologous to amino acids 1-202 of NP_001005376 (SEQ ID NO:222), which also corresponds to amino acids 1-202 of HSUPARAA_P14 (SEQ ID NO:232), and a second amino acid sequence being at least 70%, optionally at least 80%, preferably at least 85%, more preferably at least 90% and most preferably at least 95% homologous to a polypeptide having the sequence KPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:582) corresponding to amino acids 203-286 of HSUPARAA_P14 (SEQ ID NO:232), wherein said first amino acid sequence and second amino acid sequence are contiguous and in a sequential order.

An isolated polypeptide encoding for an edge portion of HSUPARAA_P14 (SEQ ID NO:232), comprising an amino acid sequence being at least 70%, optionally at least about 80%, preferably at least about 85%, more preferably at least about 90% and most preferably at least about 95% homologous to the sequence KPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:582) of HSUPARAA_P14 (SEQ ID NO:232).

An isolated chimeric polypeptide encoding for HSUPARAA_P14 (SEQ ID NO:232), comprising a first amino acid sequence being at least 90% homologous to amino acids 1-202 of Q03405-2 (SEQ ID NO:219), which also corresponds to amino acids 1-202 of HSUPARAA_P14 (SEQ ID NO:232), and a second amino acid sequence being at least 70%, optionally at least 80%, preferably at least 85%, more preferably at least 90% and most preferably at least 95% homologous to a polypeptide having the sequence KPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:582) corresponding to amino acids 203-286 of HSUPARAA_P14 (SEQ ID NO:232), wherein said first amino acid sequence and second amino acid sequence are contiguous and in a sequential order.

An isolated polypeptide encoding for an edge portion of HSUPARAA_P14 (SEQ ID NO:232), comprising an amino acid sequence being at least 70%, optionally at least about 80%, preferably at least about 85%, more preferably at least about 90% and most preferably at least about 95% homologous to the sequence KPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:582) of HSUPARAA_P14 (SEQ ID NO:232).

An isolated chimeric polypeptide encoding for HSU-PARAA_P15 (SEQ ID NO:233), comprising a first amino acid sequence being at least 90% homologous to amino acids 1-202 of UPAR_HUMAN (SEQ ID NO:593), which also corresponds to amino acids 1-202 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence SKERETQNRKTKAIW (SEQ ID NO:583) corresponding to amino acids 203-217 of HSUPARAA_P15 (SEQ ID NO:233), wherein said first amino acid sequence and second amino acid sequence are contiguous and in a sequential order.

An isolated polypeptide encoding for an edge portion of HSUPARAA P15 (SEQ ID NO:233), comprising an amino acid sequence being at least 70%, optionally at least about 80%, preferably at least about 85%, more preferably at least about 90% and most preferably at least about 95% homologous to the sequence SKERETQNRKTKAIW (SEQ ID NO:583) of HSUPARAA_P15 (SEQ ID NO:233).

An isolated chimeric polypeptide encoding for HSU-PARAA_P15 (SEQ ID NO:233), comprising a first amino acid sequence being at least 90% homologous to amino acids 1-202 of Q9UPI5_HUMAN (SEQ ID NO:218), which also corresponds to amino acids 1-202 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence SKERETQNRKTKAIW (SEQ ID NO:583) corresponding to amino acids 203-217 of HSUPARAA_P15 (SEQ ID NO:233), wherein said first amino acid sequence and second amino acid sequence are contiguous and in a sequential order.

An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence SKERETQNRKTKAIW (SEQ ID NO:583) of HSUPARAA_P15 (SEQ ID NO:233).

An isolated chimeric polypeptide encoding for HSU-PARAA_P15 (SEQ ID NO:233), comprising a first amino acid sequence being at least 90% homologous to amino acids 1-202 of Q03405-2 (SEQ ID NO:219), which also corresponds to amino acids 1-202 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence SKERETQNRKTKAIW (SEQ ID NO:583) corresponding to amino acids 203-217 of HSUPARAA_P15 (SEQ ID NO:233), wherein said first amino acid sequence and second amino acid sequence are contiguous and in a sequential order.

An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence SKERETQNRKTKAIW (SEQ ID NO:583) of HSUPARAA_P15 (SEQ ID NO:233).

An isolated chimeric polypeptide encoding for HSU-PARAA_P15 (SEQ ID NO:233), comprising a first amino acid sequence being at least 90% homologous to amino acids 1-202 of NP_001005376 (SEQ ID NO:222), which also corresponds to amino acids 1-202 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence SKERETQNRKTKAIW (SEQ ID NO:583) corresponding to amino acids 203-217 of HSUPARAA_P15 (SEQ ID NO:233), wherein said first amino acid sequence and second amino acid sequence are contiguous and in a sequential order.

An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence SKERETQNRKTKAIW (SEQ ID NO:583) of HSUPARAA_P15 (SEQ ID NO:233).

An isolated chimeric polypeptide encoding for HSU-PARAA_P15 (SEQ ID NO:233), comprising a first amino acid sequence being at least 90% homologous to amino acids 1-164 of Q9BWT0_HUMAN (SEQ ID NO:223), which also corresponds to amino acids 1-164 of HSUPARAA_P15 (SEQ ID NO:233), a bridging amino acid H corresponding to amino acid 165 of HSUPARAA_P15 (SEQ ID NO:233), a second amino acid sequence being at least 90% homologous to amino acids 166-202 of Q9BWT0_HUMAN (SEQ ID NO:223), which also corresponds to amino acids 166-202 of HSUPARAA_P15 (SEQ ID NO:233), and a third amino acid sequence being at least 70%, optionally at least 80%, preferably at least 85%, more preferably at least 90% and most preferably at least 95% homologous to a polypeptide having the sequence SKERETQNRKTKAIW (SEQ ID NO:583) corresponding to amino acids 203-217 of HSUPARAA_P15 (SEQ ID NO:233), wherein said first amino acid sequence, bridging amino acid, second amino acid sequence and third amino acid sequence are contiguous and in a sequential order.

An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence SKERETQNRKTKAIW (SEQ ID NO:583) of HSUPARAA_P15 (SEQ ID NO:233).

An isolated chimeric polypeptide encoding for HSU-PARAA_P15 (SEQ ID NO:233), comprising a first amino acid sequence being at least 90% homologous to amino acids 1-202 of NP_002650 (SEQ ID NO:217), which also corresponds to amino acids 1-202 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence SKERETQNRKTKAIW (SEQ ID NO:583) corresponding to amino acids 203-217 of HSUPARAA_P15 (SEQ ID NO:233), wherein said first amino acid sequence and second amino acid sequence are contiguous and in a sequential order.

An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence SKERETQNRKTKAIW (SEQ ID NO:583) of HSUPARAA_P15 (SEQ ID NO:233).

An isolated chimeric polypeptide encoding for HSU-PARAA_P15 (SEQ ID NO:233), comprising a first amino acid sequence being at least 90% homologous to amino acids 1-157 of NP_001005377 (SEQ ID NO:221), which also corresponds to amino acids 1-157 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence GRPKDDRHLRGCGYLPGCPGSNGFHNNDTFHFLKCCNTTKCNEGPSKERETQNRKTKAI W (SEQ ID NO:584) corresponding to amino acids 158-217 of HSUPARAA_P15 (SEQ ID NO:233), wherein said first amino acid sequence and second amino acid sequence are contiguous and in a sequential order.

An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNGFHNNDTFHFLKCCNTTKCNEGPSKERETQNRKTKAI W (SEQ ID NO:584) of HSUPARAA_P15 (SEQ ID NO:233).

An isolated chimeric polypeptide encoding for HSUPARAA_P15 (SEQ ID NO:233), comprising a first amino acid sequence being at least 90% homologous to amino acids 1-157 of Q03405-3 (SEQ ID NO:220), which also corresponds to amino acids 1-157 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence GRPKDDRHLRGCGYLPGCPGSNGFHNNDTFHFLKCCNTTKCNEGPSKERETQNRKTKAI W (SEQ ID NO:584) corresponding to amino acids 158-217 of HSUPARAA_P15 (SEQ ID NO:233), wherein said first amino acid sequence and second amino acid sequence are contiguous and in a sequential order.

An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNGFHNNDTFHFLKCCNTTKCNEGPSKERETQNRKTKAI W (SEQ ID NO:584) of HSUPARAA_P15 (SEQ ID NO:233).

An isolated chimeric polypeptide encoding for HSUPARAA_P16 (SEQ ID NO:234), comprising a first amino acid sequence being at least 90% homologous to amino acids 1-55 of UPAR_HUMAN (SEQ ID NO:593), which also corresponds to amino acids 1-55 of HSUPARAA_P16 (SEQ ID NO:234), and a second amino acid sequence being at least 90% homologous to amino acids 104-335 of UPAR_HUMAN (SEQ ID NO:593), which also corresponds to amino acids 56-287 of HSUPARAA_P16 (SEQ ID NO:234), wherein said first amino acid sequence and second amino acid sequence are contiguous and in a sequential order.

An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

An isolated chimeric polypeptide encoding for HSUPARAA_P16 (SEQ ID NO:234), comprising a first amino acid sequence being at least 90% homologous to MGHPPLLPLLLLLHTCVPASWGLRCMQCKTNGDCRVEECALGQDLCRTTIVRLWE corresponding to amino acids 1-55 of NP_002650 (SEQ ID NO:217), which also corresponds to amino acids 1-55 of HSUPARAA_P16 (SEQ ID NO:234), and a second amino acid sequence being at least 90% homologous to amino acids 104-335 of NP_002650 (SEQ ID NO:217), which also corresponds to amino acids 56-287 of HSUPARAA_P16 (SEQ ID NO:234), wherein said first amino acid sequence and second amino acid sequence are contiguous and in a sequential order.

An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

An isolated chimeric polypeptide encoding for HSUPARAA_P16 (SEQ ID NO:234), comprising a first amino acid sequence being at least 90% homologous to amino acids 1-55 of Q9BWT0_HUMAN (SEQ ID NO:223), which also corresponds to amino acids 1-55 of HSUPARAA_P16 (SEQ ID NO:234), a second amino acid sequence being at least 90% homologous to amino acids 104-164 of Q9BWT0_HUMAN (SEQ ID NO:223), which also corresponds to amino acids 56-116 of HSUPARAA_P16 (SEQ ID NO:234), a bridging amino acid H corresponding to amino acid 117 of HSUPARAA_P16 (SEQ ID NO:234), a third amino acid sequence being at least 90% homologous to amino acids 166-301 of Q9BWT0_HUMAN (SEQ ID NO:223), which also corresponds to amino acids 118-253 of HSUPARAA_P16 (SEQ ID NO:234), and a fourth amino acid sequence being at least 70%, optionally at least 80%, preferably at least 85%, more preferably at least 90% and most preferably at least 95% homologous to a polypeptide having the sequence YRSGAAPQPGPAHLSLTITLLMTARLWGGTLLWT (SEQ ID NO:563) corresponding to amino acids 254-287 of HSUPARAA_P16 (SEQ ID NO:234), wherein said first amino acid sequence, second amino acid sequence, bridging amino acid, third amino acid sequence and fourth amino acid sequence are contiguous and in a sequential order.

An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

An isolated polypeptide encoding for a tail of HSUPARAA_P16 (SEQ ID NO:234), comprising a polypeptide being at least 70%, optionally at least about 80%, preferably at least about 85%, more preferably at least about 90% and most preferably at least about 95% homologous to the sequence YRSGAAPQPGPAHLSLTITLLMTARLWGGTLLWT (SEQ ID NO:563) of HSUPARAA_P16 (SEQ ID NO:234).

An isolated chimeric polypeptide encoding for HSUPARAA_P16 (SEQ ID NO:234), comprising a first amino acid sequence being at least 90% homologous to amino acids 1-55 of Q03405-3 (SEQ ID NO:220), which also corresponds to amino acids 1-55 of HSUPARAA_P16 (SEQ ID NO:234), a second amino acid sequence being at least 90% homologous to amino acids 104-157 of Q03405-3 (SEQ ID NO:220), which also corresponds to amino acids 56-109 of HSUPARAA_P16 (SEQ ID NO:234), a third amino acid sequence being at least 70%, optionally at least 80%, preferably at least 85%, more preferably at least 90% and most preferably at least 95% homologous to a polypeptide having the sequence GRPKDDRHLRGCGYLPGCPGSNGF-HNNDTFHFLKCCNTTKCNEGP (SEQ ID NO:564) corresponding to amino acids 110-154 of HSUPARAA_P16 (SEQ ID NO:234), and a fourth amino acid sequence being at least 90% homologous to amino acids 158-290 of Q03405-3 (SEQ ID NO:220), which also corresponds to amino acids 155-287 of HSUPARAA_P16 (SEQ ID NO:234), wherein said first amino acid sequence, second amino acid sequence, third amino acid sequence and fourth amino acid sequence are contiguous and in a sequential order.

An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

An isolated polypeptide encoding for an edge portion of HSUPARAA_P16 (SEQ ID NO:234), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGP (SEQ ID NO:564) of HSUPARAA_P16 (SEQ ID NO:234).

An isolated chimeric polypeptide encoding for HSUPARAA_P16 (SEQ ID NO:234), comprising a first amino acid sequence being at least 90% homologous to amino acids 1-55 of NP_001005377 (SEQ ID NO:221), which also corresponds to amino acids 1-55 of HSUPARAA_P16 (SEQ ID NO:234), a second amino acid sequence being at least 90% homologous to amino acids 104-157 of NP_001005377 (SEQ ID NO:221), which also corresponds to amino acids 56-109 of HSUPARAA_P16 (SEQ ID NO:234), a third amino acid sequence being at least 70%, optionally at least 80%, preferably at least 85%, more preferably at least 90% and most preferably at least 95% homologous to a polypeptide having the sequence GRPKDDRHLRGCGYLPGCPG-SNGFHNNDTFHFLKCCNTTKCNEGPI (SEQ ID NO:565) corresponding to amino acids 110-155 of HSUPARAA_P16 (SEQ ID NO:234), and a fourth amino acid sequence being at least 90% homologous to amino acids 159-290 of NP_001005377 (SEQ ID NO:221), which also corresponds to amino acids 156-287 of HSUPARAA_P16 (SEQ ID NO:234), wherein said first amino acid sequence, second amino acid sequence, third amino acid sequence and fourth amino acid sequence are contiguous and in a sequential order.

An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

An isolated polypeptide encoding for an edge portion of HSUPARAA_P16 (SEQ ID NO:234), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGPI (SEQ ID NO:565) of HSUPARAA_P16 (SEQ ID NO:234).

A bridge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows (numbering according to HSUPARAA_P16): a sequence starting from any of amino acid numbers 109-x to 109; and ending at any of amino acid numbers 110+((n−2)−x), in which x varies from 0 to n−2.

A bridge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IL, having a structure as follows (numbering according to HSUPARAA_P16): a sequence starting from any of amino acid numbers 155-x to 155; and ending at any of amino acid numbers 156+((n−2)−x), in which x varies from 0 to n−2. An isolated chimeric polypeptide encoding for HSUPARAA_P16 (SEQ ID NO:234), comprising a first amino acid sequence being at least 90% homologous to amino acids 1-55 of Q9UPI5_HUMAN (SEQ ID NO:218), which also corresponds to amino acids 1-55 of HSUPARAA_P16 (SEQ ID NO:234), a second amino acid sequence being at least 90% homologous to amino acids 104-251 of Q9UPI5_HUMAN (SEQ ID NO:218), which also corresponds to amino acids 56-203 of HSUPARAA_P16 (SEQ ID NO:234), and a third amino acid sequence being at least 70%, optionally at least 80%, preferably at least 85%, more preferably at least 90% and most preferably at least 95% homologous to a polypeptide having the sequence EPKNQSYM-VRGCATASMCQHAHLGDAFSMNHIDVSCCTKSGCNH PDLDVQYRSGAAPQ PGPAHLSLTITLLMTARLWG-GTLLWT (SEQ ID NO:566) corresponding to amino acids 204-287 of HSUPARAA_P16 (SEQ ID NO:234), wherein said first amino acid sequence, second amino acid sequence and third amino acid sequence are contiguous and in a sequential order.

An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

An isolated polypeptide encoding for a tail of HSU-PARAA_P16 (SEQ ID NO:234), comprising a polypeptide being at least 70%, optionally at least about 80%, preferably at least about 85%, more preferably at least about 90% and most preferably at least about 95% homologous to the sequence EPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:566) of HSUPARAA_P16 (SEQ ID NO:234).

An isolated chimeric polypeptide encoding for HSU-PARAA_P16 (SEQ ID NO:234), comprising a first amino acid sequence being at least 90% homologous to amino acids 1-55 of NP_001005376 (SEQ ID NO:222), which also corresponds to amino acids 1-55 of HSUPARAA_P16 (SEQ ID NO:234), a second amino acid sequence being at least 90% homologous to amino acids 104-252 of NP_001005376 (SEQ ID NO:222), which also corresponds to amino acids 56-204 of HSUPARAA_P16 (SEQ ID NO:234), and a third amino acid sequence being at least 70%, optionally at least 80%, preferably at least 85%, more preferably at least 90% and most preferably at least 95% homologous to a polypeptide having the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) corresponding to amino acids 205-287 of HSUPARAA_P16 (SEQ ID NO:234), wherein said first amino acid sequence, second amino acid sequence and third amino acid sequence are contiguous and in a sequential order.

An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

An isolated polypeptide encoding for an edge portion of HSUPARAA_P16 (SEQ ID NO:234), comprising an amino acid sequence being at least 70%, optionally at least about 80%, preferably at least about 85%, more preferably at least about 90% and most preferably at least about 95% homologous to the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) of HSUPARAA_P16 (SEQ ID NO:234).

An isolated chimeric polypeptide encoding for HSU-PARAA_P16 (SEQ ID NO:234), comprising a first amino acid sequence being at least 90% homologous to amino acids 1-55 of Q03405-2 (SEQ ID NO:219), which also corresponds to amino acids 1-55 of HSUPARAA_P16 (SEQ ID NO:234), a second amino acid sequence being at least 90% homologous to amino acids 104-252 of Q03405-2 (SEQ ID NO:219), which also corresponds to amino acids 56-204 of HSU-PARAA_P16 (SEQ ID NO:234), and a third amino acid sequence being at least 70%, optionally at least 80%, preferably at least 85%, more preferably at least 90% and most preferably at least 95% homologous to a polypeptide having the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) corresponding to amino acids 205-287 of HSUPARAA_P16 (SEQ ID NO:234), wherein said first amino acid sequence, second amino acid sequence and third amino acid sequence are contiguous and in a sequential order.

An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

An isolated polypeptide encoding for an edge portion of HSUPARAA_P16 (SEQ ID NO:234), comprising an amino acid sequence being at least 70%, optionally at least about 80%, preferably at least about 85%, more preferably at least about 90% and most preferably at least about 95% homologous to the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) of HSUPARAA_P16 (SEQ ID NO:234).

An isolated chimeric polypeptide encoding for R11723_1_P9 (SEQ ID NO:276), comprising a first amino acid sequence being at least 70%, optionally at least 80%, preferably at least 85%, more preferably at least 90% and most preferably at least 95%, homologous to a polypeptide having the sequence MWVLGIAATFCGLFLLPGFALQIQCYQ-CEEFQLNNDCSSPEFIVNCTVNVQDMCQKEVME QSAGIMYRKSCASSAACLIASAGSPCR-GLAPGREEQRALHKAGAVGGGVR (SEQ ID NO:605) corresponding to amino acids 1-110 of R11723_1_P9 (SEQ ID NO:276), and a second amino acid sequence being at least 90% homologous to amino acids 1-112 of Q8IXMO_HUMAN (SEQ ID NO:272), which also corresponds to amino acids 111-222 of R11723_1_P9 (SEQ ID NO:276), wherein said first amino acid sequence and second amino acid sequence are contiguous and in a sequential order.

An isolated polypeptide encoding for a head of R11723_1_P9 (SEQ ID NO:276), comprising a polypeptide being at least 70%, optionally at least about 80%, preferably at least about 85%, more preferably at least about 90% and most preferably at least about 95% homologous to the sequence MWVLGIAATFCGLFLLPGFALQIQCYQ-CEEFQLNNDCSSPEFIVNCTVNVQDMCQKEVME QSAGIMYRKSCASSAACLIASAGSPCR-GLAPGREEQRALHKAGAVGGGVR (SEQ ID NO:605) of R11723_1_P9 (SEQ ID NO:276).

An isolated chimeric polypeptide encoding for R11723_1_P9 (SEQ ID NO:276), comprising a first amino acid sequence being at least 90% homologous to amino acids 1-83 of Q96AC2_HUMAN (SEQ ID NO:275), which also corresponds to amino acids 1-83 of R11723_1_P9 (SEQ ID NO:276), and a second amino acid sequence being at least 70%, optionally at least 80%, preferably at least 85%, more preferably at least 90% and most preferably at least 95% homologous to a polypeptide having the sequence SPCR-GLAPGREEQRALHKAGA-VGGGVRMYAQALLVVGVLQRQAAAQHL-HEHPPKLLRG HRVQERVDDRAEVEKRLREGEEDHVRPE-VGPRPVVLGFGRSHDPPNLVGHPAYGQCHN NQP-WADTSRRERQRKEKHSMRTQ (SEQ ID NO:606) corresponding to amino acids 84-222 of R11723_1_P9 (SEQ ID NO:276), wherein said first amino acid sequence and second amino acid sequence are contiguous and in a sequential order.

An isolated polypeptide encoding for an edge portion of R11723_1_P9 (SEQ ID NO:276), comprising an amino acid sequence being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) of R11723_1_P9 (SEQ ID NO:276).

An isolated chimeric polypeptide encoding for R11723_1_P9 (SEQ ID NO:276), comprising a first amino acid sequence being at least 90% homologous to amino acids 24-106 of Q6ZWI4_HUMAN (SEQ ID NO:271), which also corresponds to amino acids 1-83 of R11723_1_P9 (SEQ ID NO:276), and a second amino acid sequence being at least 70%, optionally at least 80%, preferably at least 85%, more preferably at least 90% and most preferably at least 95% homologous to a polypeptide having the sequence SPCR-GLAPGREEQRALHKAGA-VGGGVRMYAQALLVVGVLQRQAAAQHL-HEHPPKLLRG HRVQERVDDRAEVEKRLREGEEDHVRPE-VGPRPVVLGFGRSHDPPNLVGHPAYGQCHN NQP-WADTSRRERQRKEKHSMRTQ (SEQ ID NO:606) corresponding to amino acids 84-222 of R11723_1_P9 (SEQ ID NO:276), wherein said, first amino acid sequence and second amino acid sequence are contiguous and in a sequential order.

An isolated polypeptide encoding for an edge portion of R11723_1_P9 (SEQ ID NO:276), comprising an amino acid sequence being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) of R11723_1_P9 (SEQ ID NO:276).

An isolated chimeric polypeptide encoding for R11723_1_P9 (SEQ ID NO:276), comprising a first amino acid sequence being at least 90% homologous to amino acids 1-83 of NP_653187, which also corresponds to amino acids 1-83 of R11723_1_P9 (SEQ ID NO:276), and a second amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) corresponding to amino acids 84-222 of R11723_1_P9 (SEQ ID NO:276), wherein said first amino acid sequence and second amino acid sequence are contiguous and in a sequential order.

An isolated polypeptide encoding for an edge portion of R11723_1_P9 (SEQ ID NO:276), comprising an amino acid sequence being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) of R11723_1_P9 (SEQ ID NO:276).

An isolated chimeric polypeptide encoding for R11723_1_P9 (SEQ ID NO:276), comprising a first amino acid sequence being at least 90% homologous to amino acids 1-83 of Q8N2G4_HUMAN (SEQ ID NO:274), which also corresponds to amino acids 1-83 of R11723_1_P9 (SEQ ID NO:276), and a second amino acid sequence being at least 70%, optionally at least 80%, preferably at least 85%, more preferably at least 90% and most preferably at least 95% homologous to a polypeptide having the sequence SPCR-GLAPGREEQRALHKAGA-VGGGVRMYAQALLVVGVLQRQAAAQHL-HEHPPKLLRG HRVQERVDDRAEVEKRLREGEEDHVRPE-VGPRPVVLGFGRSHDPPNLVGHPAYGQCHN NQP-WADTSRRERQRKEKHSMRTQ (SEQ ID NO:606) corresponding to amino acids 84-222 of R11723_1_P9 (SEQ ID NO:276), wherein said first amino acid sequence and second amino acid sequence are contiguous and in a sequential order.

An isolated polypeptide encoding for an edge portion of R11723_1_P9 (SEQ ID NO:276), comprising an amino acid sequence being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) of R11723_1_P9 (SEQ ID NO:276).

An isolated chimeric polypeptide encoding for R11723_1_P9 (SEQ ID NO:276), comprising a first amino acid sequence being at least 70%, optionally at least 80%, preferably at least 85%, more preferably at least 90% and most preferably at least 95%, homologous to a polypeptide having the sequence MWVLG (SEQ ID NO:607) corresponding to amino acids 1-5 of R11723_1_P9 (SEQ ID NO:276), a second amino acid sequence being at least 90% homologous to amino acids 22-99 of Q6ZP52_HUMAN (SEQ ID NO:273), which also corresponds to amino acids 6-83 of R11723_1_P9 (SEQ ID NO:276), and a third amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) corresponding to amino acids 84-222 of R11723_1_P9 (SEQ ID NO:276), wherein said first amino acid sequence, second amino acid sequence and third amino acid sequence are contiguous and in a sequential order.

An isolated polypeptide encoding for a head of R11723_1_P9 (SEQ ID NO:276), comprising a polypeptide being at least 70%, optionally at least about 80%, preferably at least about 85%, more preferably at least about 90% and most preferably at least about 95% homologous to the sequence MWVLG (SEQ ID NO:607) of R11723_1_P9 (SEQ ID NO:276).

An isolated polypeptide encoding for an edge portion of R11723_1_P9 (SEQ ID NO:276), comprising an amino acid sequence being at least 70%, optionally at least about 80%, preferably at least about 85%, more preferably at least about 90% and most preferably at least about 95% homologous to the sequence SPCRGLAPGREEQRALHKAGA- VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) of R11723__1_P9 (SEQ ID NO:276).

An isolated chimeric polypeptide encoding for R11723__1_P13 (SEQ ID NO:277), comprising a first amino acid sequence being at least 90% homologous to amino acids 1-18 of Q96AC2_HUMAN (SEQ ID NO:275), which also corresponds to amino acids 1-18 of R11723__1_P13 (SEQ ID NO:277), and a second amino acid sequence being at least 70%, optionally at least 80%, preferably at least 85%, more preferably at least 90% and most preferably at least 95% homologous to a polypeptide having the sequence ENTQRPAAEARLCAANPVLPV (SEQ ID NO:608) corresponding to amino acids 19-39 of R11723__1_P13 (SEQ ID NO:277), wherein said first amino acid sequence and second amino acid sequence are contiguous and in a sequential order.

An isolated polypeptide encoding for an edge portion of R11723__1_P13 (SEQ ID NO:277), comprising an amino acid sequence being at least 70%, optionally at least about 80%, preferably at least about 85%, more preferably at least about 90% and most preferably at least about 95% homologous to the sequence ENTQRPAAEARLCAANPVLPV (SEQ ID NO:608) of R11723__1_P13 (SEQ ID NO:277).

An isolated chimeric polypeptide encoding for R11723__1_P13 (SEQ ID NO:277), comprising a first amino acid sequence being at least 90% homologous to amino acids 24-41 of Q6ZWI4_HUMAN (SEQ ID NO:271), which also corresponds to amino acids 1-18 of R11723__1_P13 (SEQ ID NO:277), and a second amino acid sequence being at least 70%, optionally at least 80%, preferably at least 85%, more preferably at least 90% and most preferably at least 95% homologous to a polypeptide having the sequence ENTQRPAAEARLCAANPVLPV (SEQ ID NO:608) corresponding to amino acids 19-39 of R11723__1_P13 (SEQ ID NO:277), wherein said, first amino acid sequence and second amino acid sequence are contiguous and in a sequential order.

An isolated polypeptide encoding for an edge portion of R11723__1_P13 (SEQ ID NO:277), comprising an amino acid sequence being at least 70%, optionally at least about 80%, preferably at least about 85%, more preferably at least about 90% and most preferably at least about 95% homologous to the sequence ENTQRPAAEARLCAANPVLPV (SEQ ID NO:608) of R11723__1_P13 (SEQ ID NO:277).

An isolated chimeric polypeptide encoding for R11723__1_P13 (SEQ ID NO:277), comprising a first amino acid sequence being at least 90% homologous to amino acids 1-18 of NP__653187, which also corresponds to amino acids 1-18 of R11723__1_P13 (SEQ ID NO:277), and a second amino acid sequence being at least 70%, optionally at least 80%, preferably at least 85%, more preferably at least 90% and most preferably at least 95% homologous to a polypeptide having the sequence ENTQRPAAEARLCAANPVLPV (SEQ ID NO:608) corresponding to amino acids 19-39 of R11723__1_P13 (SEQ ID NO:277), wherein said first amino acid sequence and second amino acid sequence are contiguous and in a sequential order.

An isolated polypeptide encoding for an edge portion of R11723__1_P13 (SEQ ID NO:277), comprising an amino acid sequence being at least 70%, optionally at least about 80%, preferably at least about 85%, more preferably at least about 90% and most preferably at least about 95% homologous to the sequence ENTQRPAAEARLCAANPVLPV (SEQ ID NO:608) of R11723__1_P13 (SEQ ID NO:277).

An isolated chimeric polypeptide encoding for R11723__1_P13 (SEQ ID NO:277), comprising a first amino acid sequence being at least 90% homologous to amino acids 1-18 of Q8N2G4_HUMAN (SEQ ID NO:274), which also corresponds to amino acids 1-18 of R11723__1_P13 (SEQ ID NO:277), and a second amino acid sequence being at least 70%, optionally at least 80%, preferably at least 85%, more preferably at least 90% and most preferably at least 95% homologous to a polypeptide having the sequence ENTQRPAAEARLCAANPVLPV (SEQ ID NO:608) corresponding to amino acids 19-39 of R11723__1_P13 (SEQ ID NO:277), wherein said first amino acid sequence and second amino acid sequence are contiguous and in a sequential order.

An isolated polypeptide encoding for an edge portion of R11723__1_P13 (SEQ ID NO:277), comprising an amino acid sequence being at least 70%, optionally at least about 80%, preferably at least about 85%, more preferably at least about 90% and most preferably at least about 95% homologous to the sequence ENTQRPAAEARLCAANPVLPV (SEQ ID NO:608) of R11723__1_P13 (SEQ ID NO:277).

An isolated chimeric polypeptide encoding for R11723__1_P13 (SEQ ID NO:277), comprising a first amino acid sequence being at least 70%, optionally at least 80%, preferably at least 85%, more preferably at least 90% and most preferably at least 95%, homologous to a polypeptide having the sequence MWVLG (SEQ ID NO:607) corresponding to amino acids 1-5 of R11723__1_P13 (SEQ ID NO:277), a second amino acid sequence being at least 90% homologous to amino acids 22-34 of Q6ZP52_HUMAN (SEQ ID NO:273), which also corresponds to amino acids 6-18 of R11723__1_$_P$13 (SEQ ID NO:277), and a third amino acid sequence being at least 70%, optionally at least 80%, preferably at least 85%, more preferably at least 90% and most preferably at least 95% homologous to a polypeptide having the sequence ENTQRPAAEARLCAANPVLPV (SEQ ID NO:608) corresponding to amino acids 19-39 of R11723__1_P13 (SEQ ID NO:277), wherein said first amino acid sequence, second amino acid sequence and third amino acid sequence are contiguous and in a sequential order.

An isolated polypeptide encoding for a head of R11723__1_P13 (SEQ ID NO:277), comprising a polypeptide being at least 70%, optionally at least about 80%, preferably at least about 85%, more preferably at least about 90% and most preferably at least about 95% homologous to the sequence MWVLG (SEQ ID NO:607) of R11723__1_P13 (SEQ ID NO:277).

An isolated polypeptide encoding for an edge portion of R11723__1_P13 (SEQ ID NO:277), comprising an amino acid sequence being at least 70%, optionally at least about 80%, preferably at least about 85%, more preferably at least about 90% and most preferably at least about 95% homologous to the sequence ENTQRPAAEARLCAANPVLPV (SEQ ID NO:608) of R11723__1_P13 (SEQ ID NO:277).

An isolated chimeric polypeptide encoding for R11723__1_P14 (SEQ ID NO:278), comprising a first amino acid sequence being at least 90% homologous to amino acids 1-63 of Q96AC2_HUMAN (SEQ ID NO:275), which also corresponds to amino acids 1-63 of R11723__1_P14 (SEQ ID NO:278), and a second amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO:609) corresponding to amino acids 64-84 of R11723__1_P14 (SEQ ID NO:278), wherein said first amino acid sequence and second amino acid sequence are contiguous and in a sequential order.

An isolated polypeptide encoding for an edge portion of R11723__1_P14 (SEQ ID NO:278), comprising an amino acid sequence being at least 70%, optionally at least about 80%, preferably at least about 85%, more preferably at least about 90% and most preferably at least 95% homologous to the sequence DTKRTNTLLFEMRHFAKQLTT (SEQ ID NO:609) of R11723_1_P14 (SEQ ID NO:278).

An isolated chimeric polypeptide encoding for R11723_1_P14 (SEQ ID NO:278), comprising a first amino acid sequence being at least 90% homologous to amino acids 24-86 of Q6ZWI4_HUMAN (SEQ ID NO:271), which also corresponds to amino acids 1-63 of R11723_1_P14 (SEQ ID NO:278), and a second amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO:609) corresponding to amino acids 64-84 of R11723_1_P14 (SEQ ID NO:278), wherein said, first amino acid sequence and second amino acid sequence are contiguous and in a sequential order.

An isolated polypeptide encoding for an edge portion of R11723_1_P14 (SEQ ID NO:278), comprising an amino acid sequence being at least 70%, optionally at least about 80%, preferably at least about 85%, more preferably at least about 90% and most preferably at least about 95% homologous to the sequence DTKRTNTLLFEMRHFAKQLTT (SEQ ID NO:609) of R11723_1_P14 (SEQ ID NO:278).

An isolated chimeric polypeptide encoding for R11723_1_P14 (SEQ ID NO:278), comprising a first amino acid sequence being at least 90% homologous to amino acids 1-63 of NP_653187, which also corresponds to amino acids 1-63 of R11723_1_P14 (SEQ ID NO:278), and a second amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO:609) corresponding to amino acids 64-84 of R11723_1_P14 (SEQ ID NO:278), wherein said first amino acid sequence and second amino acid sequence are contiguous and in a sequential order.

An isolated polypeptide encoding for an edge portion of R11723_1_P14 (SEQ ID NO:278), comprising an amino acid sequence being at least 70%, optionally at least about 80%, preferably at least about 85%, more preferably at least about 90% and most preferably at least about 95% homologous to the sequence DTKRTNTLLFEMRHFAKQLTT (SEQ ID NO:609) of R11723_1_P14 (SEQ ID NO:278).

An isolated chimeric polypeptide encoding for R11723_1_P14 (SEQ ID NO:278), comprising a first amino acid sequence being at least 90% homologous to amino acids 1-63 of Q8N2G4_HUMAN (SEQ ID NO:274), which also corresponds to amino acids 1-63 of R11723_1_P14 (SEQ ID NO:278), and a second amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO:609) corresponding to amino acids 64-84 of R11723_1_P14 (SEQ ID NO:278), wherein said first amino acid sequence and second amino acid sequence are contiguous and in a sequential order.

An isolated polypeptide encoding for an edge portion of R11723_1_P14 (SEQ ID NO:278), comprising an amino acid sequence being at least 70%, optionally at least about 80%, preferably at least about 85%, more preferably at least about 90% and most preferably at least about 95% homologous to the sequence DTKRTNTLLFEMRHFAKQLTT (SEQ ID NO:609) of R11723_1_P14 (SEQ ID NO:278).

An isolated chimeric polypeptide encoding for R11723_1_P14 (SEQ ID NO:278), comprising a first amino acid sequence being at least 70%, optionally at least 80%, preferably at least 85%, more preferably at least 90% and most preferably at least 95%, homologous to a polypeptide having the sequence MWVLG (SEQ ID NO:607) corresponding to amino acids 1-5 of R11723_1_P14 (SEQ ID NO:278), a second amino acid sequence being at least 90% homologous to amino acids 22-79 of Q6ZP52_HUMAN (SEQ ID NO:273), which also corresponds to amino acids 6-63 of R11723_1_P14 (SEQ ID NO:278), and a third amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO:609) corresponding to amino acids 64-84 of R11723_1_P14 (SEQ ID NO:278), wherein said first amino acid sequence, second amino acid sequence and third amino acid sequence are contiguous and in a sequential order.

An isolated polypeptide encoding for a head of R11723_1_P14 (SEQ ID NO:278), comprising a polypeptide being at least 70%, optionally at least about 80%, preferably at least about 85%, more preferably at least about 90% and most preferably at least about 95% homologous to the sequence MWVLG (SEQ ID NO:607) of R11723_1_P14 (SEQ ID NO:278).

An isolated polypeptide encoding for an edge portion of R11723_1_P14 (SEQ ID NO:278), comprising an amino acid sequence being at least 70%, optionally at least about 80%, preferably at least 85%, more preferably at least about 90% and most preferably at least about 95% homologous to the sequence DTKRTNTLLFEMRHFAKQLTT (SEQ ID NO:609) of R11723_1_P14 (SEQ ID NO:278).

An isolated chimeric polypeptide encoding for R11723_1_P15 (SEQ ID NO:279), comprising a first amino acid sequence being at least 90% homologous to amino acids 1-64 of Q96AC2_HUMAN (SEQ ID NO:275), which also corresponds to amino acids 1-64 of R11723_1_P15 (SEQ ID NO:279), and a second amino acid sequence being at least 70%, optionally at least 80%, preferably at least 85%, more preferably at least 90% and most preferably at least 95% homologous to a polypeptide having the sequence SHCVTRLECSGTISAHCNLCLPGSNDHPT (SEQ ID NO:610) corresponding to amino acids 65-93 of R11723_1_P15 (SEQ ID NO:279), wherein said first amino acid sequence and second amino acid sequence are contiguous and in a sequential order.

An isolated polypeptide encoding for an edge portion of R11723_1_P15 (SEQ ID NO:279), comprising an amino acid sequence being at least 70%, optionally at least about 80%, preferably at least 85%, more preferably at least about 90% and most preferably at least about 95% homologous to the sequence SHCVTRLECSGTISAHCNLCLPGSNDHPT (SEQ ID NO:610) of R11723_1_P15 (SEQ ID NO:279).

An isolated chimeric polypeptide encoding for R11723_1_P15 (SEQ ID NO:279), comprising a first amino acid sequence being at least 90% homologous to amino acids 24-87 of Q6ZWI4_HUMAN (SEQ ID NO:271), which also corresponds to amino acids 1-64 of R11723_1_P15 (SEQ ID NO:279), and a second amino acid sequence being at least 70%, optionally at least 80%, preferably at least 85%, more preferably at least 90% and most preferably at least 95% homologous to a polypeptide having the sequence SHCVTRLECSGTISAHCNLCLPGSNDHPT (SEQ ID NO:610) corresponding to amino acids 65-93 of R11723_1_P15 (SEQ ID NO:279), wherein said, first amino acid sequence and second amino acid sequence are contiguous and in a sequential order.

An isolated polypeptide encoding for an edge portion of R11723_1_P15 (SEQ ID NO:279), comprising an amino acid sequence being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO:610) of R11723_1_P15 (SEQ ID NO:279).

An isolated chimeric polypeptide encoding for R11723_1_P15 (SEQ ID NO:279), comprising a first amino acid sequence being at least 90% homologous to amino acids 1-64 of NP_653187, which also corresponds to amino acids 1-64 of R11723_1_P15 (SEQ ID NO:279), and a second amino acid sequence being at least 70%, optionally at least 80%, preferably at least 85%, more preferably at least 90% and most preferably at least 95% homologous to a polypeptide having the sequence SHCVTRLECSGTISAHCNLCLPG-SNDHPT (SEQ ID NO:610) corresponding to amino acids 65-93 of R11723_1_P15 (SEQ ID NO:279), wherein said first amino acid sequence and second amino acid sequence are contiguous and in a sequential order.

An isolated polypeptide encoding for an edge portion of R11723_1_P15 (SEQ ID NO:279), comprising an amino acid sequence being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO:610) of R11723_1_P15 (SEQ ID NO:279).

An isolated chimeric polypeptide encoding for R11723_1_P15 (SEQ ID NO:279), comprising a first amino acid sequence being at least 90% homologous to amino acids 1-64 of Q8N2G4_HUMAN (SEQ ID NO:274), which also corresponds to amino acids 1-64 of R11723_1_P15 (SEQ ID NO:279), and a second amino acid sequence being at least 70%, optionally at least 80%, preferably at least 85%, more preferably at least 90% and most preferably at least 95% homologous to a polypeptide having the sequence SHCVTR-LECSGTISAHCNLCLPGSNDHPT (SEQ ID NO:610) corresponding to amino acids 65-93 of R11723_1_P15 (SEQ ID NO:279), wherein said first amino acid sequence and second amino acid sequence are contiguous and in a sequential order.

An isolated polypeptide encoding for an edge portion of R11723_1_P15 (SEQ ID NO:279), comprising an amino acid sequence being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO:610) of R11723_1_P15 (SEQ ID NO:279).

An isolated chimeric polypeptide encoding for R11723_1_P15 (SEQ ID NO:279), comprising a first amino acid sequence being at least 70%, optionally at least 80%, preferably at least 85%, more preferably at least 90% and most preferably at least 95%, homologous to a polypeptide having the sequence MWVLG (SEQ ID NO:607) corresponding to amino acids 1-5 of R11723_1_P15 (SEQ ID NO:279), a second amino acid sequence being at least 90% homologous to amino acids 22-80 of Q6ZP52_HUMAN (SEQ ID NO:273), which also corresponds to amino acids 6-64 of R11723_1_P15 (SEQ ID NO:279), and a third amino acid sequence being at least 70%, optionally at least 80%, preferably at least 85%, more preferably at least 90% and most preferably at least 95% homologous to a polypeptide having the sequence SHCVTRLECSGTISAHCNLCLPGSNDHPT (SEQ ID NO:610) corresponding to amino acids 65-93 of R11723_1_P15 (SEQ ID NO:279), wherein said first amino acid sequence, second amino acid sequence and third amino acid sequence are contiguous and in a sequential order.

An isolated polypeptide encoding for a head of R11723_1_P15 (SEQ ID NO:279), comprising a polypeptide being at least 70%, optionally at least about 80%, preferably at least about 85%, more preferably at least about 90% and most preferably at least about 95% homologous to the sequence MWVLG (SEQ ID NO:607) of R11723_1_P15 (SEQ ID NO:279).

An isolated polypeptide encoding for an edge portion of R11723_1_P15 (SEQ ID NO:279), comprising an amino acid sequence being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO:610) of R11723_1_P15 (SEQ ID NO:279).

An isolated chimeric polypeptide encoding for R11723_1_P16 (SEQ ID NO:280), comprising a first amino acid sequence being at least 90% homologous to amino acids 1-63 of Q96AC2_HUMAN (SEQ ID NO:275), which also corresponds to amino acids 1-63 of R11723_1_P16 (SEQ ID NO:280), and a second amino acid sequence being at least 70%, optionally at least 80%, preferably at least 85%, more preferably at least 90% and most preferably at least 95% homologous to a polypeptide having the sequence DRVS-LCHEAGVQWNNFSTLQPLPPRLK (SEQ ID NO:611) corresponding to amino acids 64-90 of R11723_1_P16 (SEQ ID NO:280), wherein said first amino acid sequence and second amino acid sequence are contiguous and in a sequential order.

An isolated polypeptide encoding for an edge portion of R11723_1_P16 (SEQ ID NO:280), comprising an amino acid sequence being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO:611) of R11723_1_P16 (SEQ ID NO:280).

An isolated chimeric polypeptide encoding for R11723_1_P16 (SEQ ID NO:280), comprising a first amino acid sequence being at least 90% homologous to amino acids 24-86 of Q6ZWI4_HUMAN (SEQ ID NO:271), which also corresponds to amino acids 1-63 of R11723_1_P16 (SEQ ID NO:280), and a second amino acid sequence being at least 70%, optionally at least 80%, preferably at least 85%, more preferably at least 90% and most preferably at least 95% homologous to a polypeptide having the sequence DRVS-LCHEAGVQWNNFSTLQPLPPRLK (SEQ ID NO:611) corresponding to amino acids 64-90 of R11723_1_P16 (SEQ ID NO:280), wherein said, first amino acid sequence and second amino acid sequence are contiguous and in a sequential order.

An isolated polypeptide encoding for an edge portion of R11723_1_P16 (SEQ ID NO:280), comprising an amino acid sequence being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO:611) of R11723_1_P16 (SEQ ID NO:280).

An isolated chimeric polypeptide encoding for R11723_1_P16 (SEQ ID NO:280), comprising a first amino acid sequence being at least 90% homologous to amino acids 1-63 of NP_653187, which also corresponds to amino acids 1-63 of R11723_1_P16 (SEQ ID NO:280), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQPLP-PRLK (SEQ ID NO:611) corresponding to amino acids 64-90 of R11723_1_P16 (SEQ ID NO:280), wherein said first amino acid sequence and second amino acid sequence are contiguous and in a sequential order.

An isolated polypeptide encoding for an edge portion of R11723_1_P16 (SEQ ID NO:280), comprising an amino acid sequence being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO:611) of R11723_1_P16 (SEQ ID NO:280).

An isolated chimeric polypeptide encoding for R11723_1_P16 (SEQ ID NO:280), comprising a first amino acid sequence being at least 90% homologous to amino acids 1-63 of Q8N2G4_HUMAN (SEQ ID NO:274), which also corresponds to amino acids 1-63 of R11723_1_P16 (SEQ ID NO:280), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO:611) corresponding to amino acids 64-90 of R11723_1_P16 (SEQ ID NO:280), wherein said first amino acid sequence and second amino acid sequence are contiguous and in a sequential order.

An isolated polypeptide encoding for an edge portion of R11723_1_P16 (SEQ ID NO:280), comprising an amino acid sequence being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO:611) of R11723_1_P16 (SEQ ID NO:280). An isolated chimeric polypeptide encoding for R11723_1_P16 (SEQ ID NO:280), comprising a first amino acid sequence being at least 70%, optionally at least 80%, preferably at least 85%, more preferably at least 90% and most preferably at least 95%, homologous to a polypeptide having the sequence MWVLG (SEQ ID NO:607) corresponding to amino acids 1-5 of R11723_1_P16 (SEQ ID NO:280), a second amino acid sequence being at least 90% homologous to amino acids 22-79 of Q6ZP52_HUMAN (SEQ ID NO:273), which also corresponds to amino acids 6-63 of R11723_1_P16 (SEQ ID NO:280), and a third amino acid sequence being at least 70%, optionally at least 80%, preferably at least 85%, more preferably at least 90% and most preferably at least 95% homologous to a polypeptide having the sequence DRVSLCHEAGVQWNNFSTLQPLP-PRLK (SEQ ID NO:611) corresponding to amino acids 64-90 of R11723_1_P16 (SEQ ID NO:280), wherein said first amino acid sequence, second amino acid sequence and third amino acid sequence are contiguous and in a sequential order.

An isolated polypeptide encoding for a head of R11723_1_P16 (SEQ ID NO:280), comprising a polypeptide being at least 70%, optionally at least about 80%, preferably at least about 85%, more preferably at least about 90% and most preferably at least about 95% homologous to the sequence MWVLG (SEQ ID NO:607) of R11723_1_P16 (SEQ ID NO:280).

An isolated polypeptide encoding for an edge portion of R11723_1_P16 (SEQ ID NO:280), comprising an amino acid sequence being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO:611) of R11723_1_P16 (SEQ ID NO:280).

An isolated chimeric polypeptide encoding for R11723_1_P12 (SEQ ID NO:642), comprising a first amino acid sequence being at least 70%, optionally at least 80%, preferably at least 85%, more preferably at least 90% and most preferably at least 95%, homologous to a polypeptide having the sequence EPDCVCLA (SEQ ID NO:643) corresponding to amino acids 1-8 of R11723_1_P12 (SEQ ID NO:642), and a second amino acid sequence being at least 90% homologous to amino acids 18-141 of Q96AC2_HUMAN, which also corresponds to amino acids 9-132 of R11723_1_P12 (SEQ ID NO:642), wherein said first amino acid sequence and second amino acid sequence are contiguous and in a sequential order.

An isolated polypeptide encoding for a head of R11723_1_P12 (SEQ ID NO:642), comprising a polypeptide being at least 70%, optionally at least about 80%, preferably at least about 85%, more preferably at least about 90% and most preferably at least about 95% homologous to the sequence EPDCVCLA (SEQ ID NO:643) of R11723_1_P12 (SEQ ID NO:642).

An isolated chimeric polypeptide encoding for R11723_1_P12 (SEQ ID NO:642), comprising a first amino acid sequence being at least 70%, optionally at least 80%, preferably at least 85%, more preferably at least 90% and most preferably at least 95%, homologous to a polypeptide having the sequence EPDCVCLA (SEQ ID NO:643) corresponding to amino acids 1-8 of R11723_1_P12 (SEQ ID NO:642), and a second amino acid sequence being at least 90% homologous to amino acids 34-157 of Q6ZP52_HUMAN, which also corresponds to amino acids 9-132 of R11723_1_P12 (SEQ ID NO:642), wherein said first amino acid sequence and second amino acid sequence are contiguous and in a sequential order.

An isolated polypeptide encoding for a head of R11723_1_P12 (SEQ ID NO:642), comprising a polypeptide being at least 70%, optionally at least about 80%, preferably at least about 85%, more preferably at least about 90% and most preferably at least about 95% homologous to the sequence EPDCVCLA (SEQ ID NO:643) of R11723_1_P12 (SEQ ID NO:642).

An isolated chimeric polypeptide encoding for R11723_1_P12 (SEQ ID NO:642), comprising a first amino acid sequence being at least 70%, optionally at least 80%, preferably at least 85%, more preferably at least 90% and most preferably at least 95%, homologous to a polypeptide having the sequence EPDCVCLA (SEQ ID NO:643) corresponding to amino acids 1-8 of R11723_1_P12 (SEQ ID NO:642), a second amino acid sequence being at least 90% homologous to amino acids 41-129 of Q6ZWI4_HUMAN, which also corresponds to amino acids 9-97 of R11723_1_P12 (SEQ ID NO:642), a bridging amino acid N corresponding to amino acid 98 of R11723_1_P12 (SEQ ID NO:642), a third amino acid sequence being at least 90% homologous to amino acids 131-155 of Q6ZWI4_HUMAN, which also corresponds to amino acids 99-123 of R11723_1_P12 (SEQ ID NO:642), a bridging amino acid K corresponding to amino acid 124 of R11723_1_P12 (SEQ ID NO:642), and a fourth amino acid sequence being at least 90% homologous to amino acids 157-164 of Q6ZWI4_HUMAN, which also corresponds to amino acids 125-132 of R11723_1_P12 (SEQ ID NO:642), wherein said first amino acid sequence, second amino acid sequence, bridging amino acid, third amino acid sequence, bridging amino acid and fourth amino acid sequence are contiguous and in a sequential order.

An isolated polypeptide encoding for a head of R11723_1_P12 (SEQ ID NO:642), comprising a polypeptide being at least 70%, optionally at least about 80%, preferably at least about 85%, more preferably at least about 90% and most preferably at least about 95% homologous to the sequence EPDCVCLA (SEQ ID NO:643) of R11723_1_P12 (SEQ ID NO:642).

An isolated chimeric polypeptide encoding for R11723_1_P12 (SEQ ID NO:642), comprising a first amino acid sequence being at least 70%, optionally at least 80%, preferably at least 85%, more preferably at least 90% and most preferably at least 95%, homologous to a polypeptide having the sequence EPDCVCLA (SEQ ID NO:643) corresponding to amino acids 1-8 of R11723_1_P12 (SEQ ID NO:642), a second amino acid sequence being at least 90% homologous to amino acids 18-135 of NP_653187, which also corresponds to amino acids 9-126 of R11723_1_P12 (SEQ ID NO:642), and a third amino acid sequence being at least 70%, optionally at least 80%, preferably at least 85%, more preferably at least 90% and most preferably at least 95% homologous to a polypeptide having the sequence LFSAHC (SEQ ID NO:644) corresponding to amino acids 127-132 of R11723_1_P12 (SEQ ID NO:642), wherein said first amino acid sequence, second amino acid sequence and third amino acid sequence are contiguous and in a sequential order.

An isolated polypeptide encoding for a head of R11723_1_P12 (SEQ ID NO:642), comprising a polypeptide being at least 70%, optionally at least about 80%, preferably at least about 85%, more preferably at least about 90% and most preferably at least about 95% homologous to the sequence EPDCVCLA (SEQ ID NO:643) of R11723_1_P12 (SEQ ID NO:642).

An isolated polypeptide encoding for an edge portion of R11723_1_P12 (SEQ ID NO:642), comprising an amino acid sequence being at least 70%, optionally at least about 80%, preferably at least about 85%, more preferably at least about 90% and most preferably at least about 95% homologous to the sequence LFSAHC (SEQ ID NO:644) of R11723_1_P12 (SEQ ID NO:642).

An isolated chimeric polypeptide encoding for R11723_1_P12 (SEQ ID NO:642), comprising a first amino acid sequence being at least 70%, optionally at least 80%, preferably at least 85%, more preferably at least 90% and most preferably at least 95%, homologous to a polypeptide having the sequence EPDCVCLA (SEQ ID NO:643) corresponding to amino acids 1-8 of R11723_1_P12 (SEQ ID NO:642), a second amino acid sequence being at least 90% homologous to amino acids 18-135 of Q8N2G4_HUMAN, which also corresponds to amino acids 9-126 of R11723_1_P12 (SEQ ID NO:642), and a third amino acid sequence being at least 70%, optionally at least 80%, preferably at least 85%, more preferably at least 90% and most preferably at least 95% homologous to a polypeptide having the sequence LFSAHC (SEQ ID NO:644) corresponding to amino acids 127-132 of R11723_1_P12 (SEQ ID NO:642), wherein said first amino acid sequence, second amino acid sequence and third amino acid sequence are contiguous and in a sequential order.

An isolated polypeptide encoding for a head of R11723_1_P12 (SEQ ID NO:642), comprising a polypeptide being at least 70%, optionally at least about 80%, preferably at least about 85%, more preferably at least about 90% and most preferably at least about 95% homologous to the sequence EPDCVCLA (SEQ ID NO:643) of R11723_1_P12 (SEQ ID NO:642).

An isolated polypeptide encoding for an edge portion of R11723_1_P12 (SEQ ID NO:642), comprising an amino acid sequence being at least 70%, optionally at least about 80%, preferably at least about 85%, more preferably at least about 90% and most preferably at least about 95% homologous to the sequence LFSAHC (SEQ ID NO:644) of R11723_1_P12 (SEQ ID NO:642).

An isolated chimeric polypeptide encoding for T27396_PEA_1_P3 (SEQ ID NO:339), comprising a first amino acid sequence being at least 90% homologous to amino acids 1-119 of ST14_HUMAN (SEQ ID NO:594), which also corresponds to amino acids 1-119 of T27396_PEA_1_P3 (SEQ ID NO:339), and a second amino acid sequence being at least 90% homologous to amino acids 124-855 of ST14_HUMAN (SEQ ID NO:594), which also corresponds to amino acids 120-851 of T27396_PEA_1_P3 (SEQ ID NO:339), wherein said first amino acid sequence and second amino acid sequence are contiguous and in a sequential order.

An isolated chimeric polypeptide encoding for an edge portion of T27396_PEA_1_P3 (SEQ ID NO:339), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KL, having a structure as follows: a sequence starting from any of amino acid numbers 119-x to 119; and ending at any of amino acid numbers 120+((n−2)−x), in which x varies from 0 to n−2.

An isolated chimeric polypeptide encoding for T27396_PEA_1_P4 (SEQ ID NO:340), comprising a first amino acid sequence being at least 90% homologous to amino acids 1-211 of ST14_HUMAN (SEQ ID NO:594), which also corresponds to amino acids 1-211 of T27396_PEA_1_P4 (SEQ ID NO:340), a second amino acid sequence being at least 70%, optionally at least 80%, preferably at least 85%, more preferably at least 90% and most preferably at least 95% homologous to a polypeptide having the sequence TLPSPAPTRALLLVSCAD (SEQ ID NO:596) corresponding to amino acids 212-229 of T27396_PEA_1_P4 (SEQ ID NO:340), and a third amino acid sequence being at least 90% homologous to amino acids 213-855 of ST14_HUMAN (SEQ ID NO:594), which also corresponds to amino acids 230-872 of T27396_PEA_1_P4 (SEQ ID NO:340), wherein said first amino acid sequence, second amino acid sequence and third amino acid sequence are contiguous and in a sequential order.

An isolated polypeptide encoding for an edge portion of T27396_PEA_1_P4 (SEQ ID NO:340), comprising an amino acid sequence being at least 70%, optionally at least 80%, preferably at least 85%, more preferably at least 90% and most preferably at least 95% homologous to the sequence encoding for TLPSPAPTRALLLVSCAD (SEQ ID NO:596), corresponding to amino acids 212-229 of T27396_PEA_1_P4 (SEQ ID NO:340).

A bridge portion of T27396_PEA_1_P4 (SEQ ID NO:340), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DT, having a structure as follows (numbering according to T27396_PEA_1_P4): a sequence starting from any of amino acid numbers 211-x to 211; and ending at any of amino acid numbers 212+((n−2)−x), in which x varies from 0 to n−2.

A bridge portion of T27396_PEA_1_P4 (SEQ ID NO:340), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DS, having a structure as follows (numbering according to T27396_PEA_1_P4): a sequence starting from any of amino acid numbers 229-x to 229; and ending at any of amino acid numbers 230+((n−2)−x), in which x varies from 0 to n−2.

An isolated chimeric polypeptide encoding for T27396 PEA_1_P10 (SEQ ID NO:341), comprising a first amino acid sequence being at least 90% homologous to amino acids 1-523 of ST14_HUMAN (SEQ ID NO:594), which also corresponds to amino acids 1-523 of T27396_PEA_1_P10 (SEQ ID NO:341), a second amino acid sequence bridging amino acid sequence comprising of M, and a third amino acid sequence being at least 90% homologous to amino acids 563-855 of ST14_HUMAN (SEQ ID NO:594), which also corresponds to amino acids 525-817 of T27396_PEA_1_P10 (SEQ ID NO:341), wherein said first amino acid sequence, second amino acid sequence and third amino acid sequence are contiguous and in a sequential order.

An isolated polypeptide encoding for an edge portion of T27396_PEA_1_P10 (SEQ ID NO:341), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CM having a structure as follows (numbering according to T27396_PEA_1_P10): a sequence starting from any of amino acid numbers 523-x to 523; and ending at any of amino acid numbers 524+((n−2)−x), in which x varies from 0 to n−2.

An isolated polypeptide encoding for an edge portion of T27396_PEA_1_P10 (SEQ ID NO:341), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise MN having a structure as follows (numbering according to T27396_PEA_1_P10): a sequence starting from any of amino acid numbers 524-x to 524; and ending at any of amino acid numbers 525+((n−2)−x), in which x varies from 0 to n−2.

An isolated chimeric polypeptide encoding for T27396_PEA_1_P12 (SEQ ID NO:342), comprising a first amino acid sequence being at least 90% homologous to amino acids 1-757 of ST14_HUMAN (SEQ ID NO:594), which also corresponds to amino acids 1-757 of T27396_PEA_1_P12 (SEQ ID NO:342), and a second amino acid sequence being at least 70%, optionally at least 80%, preferably at least 85%, more preferably at least 90% and most preferably at least 95% homologous to a polypeptide having the sequence GCYCQSPLSRRGLPVCQPRAS-ALFQSFLVQ (SEQ ID NO:597) corresponding to amino acids 758-787 of T27396_PEA_1_P12 (SEQ ID NO:342), wherein said first amino acid sequence and second amino acid sequence are contiguous and in a sequential order.

An isolated polypeptide encoding for a tail of T27396_PEA_1_P12 (SEQ ID NO:342), comprising a polypeptide being at least 70%, optionally at least 80%, preferably at least 85%, more preferably at least 90% and most preferably at least 95% homologous to the sequence GCYC-QSPLSRRGLPVCQPRASALFQSFLVQ (SEQ ID NO:597) in T27396_PEA_1_P12 (SEQ ID NO:342).

An isolated chimeric polypeptide encoding for T27396_PEA_1_P13 (SEQ ID NO:343), comprising a first amino acid sequence being at least 90% homologous to amino acids 1-665 of ST14_HUMAN (SEQ ID NO:594), which also corresponds to amino acids 1-665 of T27396_PEA_1_P13 (SEQ ID NO:343), and a second amino acid sequence being at least 70%, optionally at least 80%, preferably at least 85%, more preferably at least 90% and most preferably at least 95% homologous to a polypeptide having the sequence PHAVDGLPGLARPEPAQRPW-GAGAQAQAHHLPPLLQ (SEQ ID NO:598) corresponding to amino acids 666-701 of T27396_PEA_1_P13 (SEQ ID NO:343), wherein said first amino acid sequence and second amino acid sequence are contiguous and in a sequential order.

An isolated polypeptide encoding for a tail of T27396_PEA_1_P13 (SEQ ID NO:343), comprising a polypeptide being at least 70%, optionally at least 80%, preferably at least 85%, more preferably at least 90% and most preferably at least 95% homologous to the sequence PHAVDGLPGLARPEPAQRPWGAGAQ(AQAHHLP-PLLQ (SEQ ID NO:598) in T27396_PEA_1_P13 (SEQ ID NO:343).

An isolated chimeric polypeptide encoding for T27396_PEA_1_P14 (SEQ ID NO:344), comprising a first amino acid sequence being at least 90% homologous to amino acids 1-789 of ST14_HUMAN (SEQ ID NO:594), which also corresponds to amino acids 1-789 of T27396_PEA_1_P14 (SEQ ID NO:344), and a second amino acid sequence being at least 70%, optionally at least 80%, preferably at least 85%, more preferably at least 90% and most preferably at least 95% homologous to a polypeptide having the sequence VIPGDPCPAWRRMGGSSRPVW (SEQ ID NO:599) corresponding to amino acids 790-810 of T27396_PEA_1_P14 (SEQ ID NO:344), wherein said first amino acid sequence and second amino acid sequence are contiguous and in a sequential order.

An isolated polypeptide encoding for a tail of T27396_PEA_1_P14 (SEQ ID NO:344), comprising a polypeptide being at least 70%, optionally at least 80%, preferably at least 85%, more preferably at least 90% and most preferably at least 95% homologous to the sequence VIPGD-PCPAWRRMGGSSRPVW (SEQ ID NO:599) in T27396_PEA_1_P14 (SEQ ID NO:344).

An isolated chimeric polypeptide encoding for T27396_PEA_1_P18 (SEQ ID NO:345), comprising a first amino acid sequence being at least 90% homologous to amino acids 1-757 of ST14_HUMAN (SEQ ID NO:594), which also corresponds to amino acids 1-757 of T27396_PEA_1_P18 (SEQ ID NO:345).

An isolated chimeric polypeptide encoding for T27396_PEA_1_P24 (SEQ ID NO:346), comprising a first amino acid sequence being at least 90% homologous to MGSDRARKGGGGPKDFGAGLKYNSRHEK-VNGLEEGVEFLPVNNVKK (SEQ ID NO:600) corresponding to amino acids 1-46 of ST14_HUMAN (SEQ ID NO:594), which also corresponds to amino acids 1-46 of T27396_PEA_1_P24 (SEQ ID NO:346), and a second amino acid sequence being at least 90% homologous to amino acids 672-855 of ST14_HUMAN (SEQ ID NO:594), which also corresponds to amino acids 47-230 of T27396_PEA_1_P24 (SEQ ID NO:346), wherein said first amino acid sequence and second amino acid sequence are contiguous and in a sequential order.

An isolated chimeric polypeptide encoding for an edge portion of T27396_PEA_1_P24 (SEQ ID NO:346), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KW, having a structure as follows: a sequence starting from any of amino acid numbers 46-x to 46; and ending at any of amino acid numbers 47+((n−2)−x), in which x varies from 0 to n−2.

An isolated chimeric polypeptide encoding for T27396_PEA_1_P26 (SEQ ID NO:347), comprising a first amino acid sequence being at least 90% homologous to amino acids 1-602 of ST14_HUMAN (SEQ ID NO:594), which also corresponds to amino acids 1-602 of T27396_PEA_1_P26 (SEQ ID NO:347), and a second amino acid sequence being at least 70%, optionally at least 80%, preferably at least 85%, more preferably at least 90% and most preferably at least 95% homologous to a polypeptide having the sequence ELWPSAFKGASPCSMLPPPL (SEQ ID NO:601) corresponding to amino acids 603-622 of T27396_PEA_1_P26 (SEQ ID NO:347), wherein said first amino acid sequence and second amino acid sequence are contiguous and in a sequential order.

An isolated polypeptide encoding for a tail of T27396_PEA_1_P26 (SEQ ID NO:347), comprising a polypeptide being at least 70%, optionally at least 80%, preferably at least 85%, more preferably at least 90% and most preferably at least 95% homologous to the sequence ELWPSAFKGASPCSMLPPPL (SEQ ID NO:601) in T27396_PEA_1_P26 (SEQ ID NO:347).

An isolated chimeric polypeptide encoding for T27396_PEA_1_P27 (SEQ ID NO:348), comprising a first amino acid sequence being at least 90% homologous to amino acids 1-46 of ST14_HUMAN (SEQ ID NO:594), which also corresponds to amino acids 1-46 of T27396_PEA_1_P27 (SEQ ID NO:348), a second amino acid sequence being at least 90% homologous to amino acids 672-802 of ST14_HUMAN (SEQ ID NO:594), which also corresponds to amino acids 47-177 of T27396_PEA_1_P27 (SEQ ID NO:348), and a third amino acid sequence being at least 70%, optionally at least 80%, preferably at least 85%, more preferably at least 90% and most preferably at least 95% homologous to a polypeptide having the sequence VAPGAGGRQVGPGRGGTGDSRQGLSPPRVIPGD-PCPAWRRMGGSSRPVW (SEQ ID NO:602) corresponding to amino acids 178-226 of T27396_PEA_1_P27 (SEQ ID NO:348), wherein said first amino acid sequence, second amino acid sequence and third amino acid sequence are contiguous and in a sequential order.

An isolated chimeric polypeptide encoding for an edge portion of T27396_PEA_1_P27 (SEQ ID NO:348), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KW, having a structure as follows: a sequence starting from any of amino acid numbers 46-x to 46; and ending at any of amino acid numbers 47+((n−2)−x), in which x varies from 0 to n−2.

An isolated polypeptide encoding for a tail of T27396_PEA_1_P27 (SEQ ID NO:348), comprising a polypeptide being at least 70%, optionally at least 80%, preferably at least 85%, more preferably at least 90% and most preferably at least 95% homologous to the sequence VAPG-AGGRQVGPGRGGTGDSRQGLSP-PRVIPGDPCPAWRRMGGSSRPVW (SEQ ID NO:602) in T27396_PEA_1_P27 (SEQ ID NO:348).

An isolated chimeric polypeptide encoding for T27396_PEA_1_P30 (SEQ ID NO:349), comprising a first amino acid sequence being at least 90% homologous to amino acids 1-790 of ST14_HUMAN (SEQ ID NO:594), which also corresponds to amino acids 1-790 of T27396_PEA_1_P30 (SEQ ID NO:349), and a second amino acid sequence being at least 70%, optionally at least 80%, preferably at least 85%, more preferably at least 90% and most preferably at least 95% homologous to a polypeptide having the sequence GGLQCVYLCK (SEQ ID NO:603) corresponding to amino acids 791-800 of T27396_PEA_1_P30 (SEQ ID NO:349), wherein said first amino acid sequence and second amino acid sequence are contiguous and in a sequential order.

An isolated polypeptide encoding for a tail of T27396_PEA_1_P30 (SEQ ID NO:349), comprising a polypeptide being at least 70%, optionally at least 80%, preferably at least 85%, more preferably at least 90% and most preferably at least 95% homologous to the sequence GGLQCVYLCK (SEQ ID NO:603) in T27396_PEA_1_P30 (SEQ ID NO:349).

An isolated chimeric polypeptide encoding for T51958_P1 (SEQ ID NO:423), comprising a first amino acid sequence being at least 90% homologous to amino acids 1-91 of PTK7_HUMAN (SEQ ID NO:595), which also corresponds to amino acids 1-91 of T51958_P1 (SEQ ID NO:423), a bridging amino acid R corresponding to amino acid 92 of T51958_P1 (SEQ ID NO:423), a second amino acid sequence being at least 90% homologous to amino acids 93-146 of PTK7_HUMAN (SEQ ID NO:595), which also corresponds to amino acids 93-146 of T51958_P1 (SEQ ID NO:423), a bridging amino acid T corresponding to amino acid 147 of T51958_P1 (SEQ ID NO:423), a third amino acid sequence being at least 90% homologous to amino acids 148-206 of PTK7_HUMAN (SEQ ID NO:595), which also corresponds to amino acids 148-206 of T51958_P1 (SEQ ID NO:423), a bridging amino acid G corresponding to amino acid 207 of T51958_P1 (SEQ ID NO:423), a fourth amino acid sequence being at least 90% homologous to amino acids 208-494 of PTK7_HUMAN (SEQ ID NO:595), which also corresponds to amino acids 208-494 of T51958_P1 (SEQ ID NO:423), bridging amino acids RV corresponding to amino acid 495-496 of T51958_P1 (SEQ ID NO:423), a fifth amino acid sequence being at least 90% homologous to amino acids 497-514 of PTK7_HUMAN (SEQ ID NO:595), which also corresponds to amino acids 497-514 of T51958_P1 (SEQ ID NO:423), a bridging amino acid E corresponding to amino acid 515 of T51958_P1 (SEQ ID NO:423), a sixth amino acid sequence being at least 90% homologous to amino acids 516-682 of PTK7_HUMAN (SEQ ID NO:595), which also corresponds to amino acids 516-682 of T51958_P1 (SEQ ID NO:423), and a seventh amino acid sequence being at least 70%, optionally at least 80%, preferably at least 85%, more preferably at least 90% and most preferably at least 95% homologous to a polypeptide having the sequence GMGWG-GLCCTGSGGPRRLSPCTQPLCTEH-GTEAIFVAAVGIRPSHHAAAQS (SEQ ID NO:618) corresponding to amino acids 683-733 of T51958_P1 (SEQ ID NO:423), wherein said first amino acid sequence, bridging amino acid, second amino acid sequence, bridging amino acid, third amino acid sequence, bridging amino acid, fourth amino acid sequence, bridging amino acid, fifth amino acid sequence, bridging amino acid, sixth amino acid sequence and seventh amino acid sequence are contiguous and in a sequential order.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQPLCTEHGTEAIFVAAVGIRPSHHAAAQS (SEQ ID NO:618) of T51958_P1 (SEQ ID NO:423).

An isolated chimeric polypeptide encoding for T51958_P1 (SEQ ID NO:423), comprising a first amino acid sequence being at least 90% homologous to amino acids 1-682 of Q8NFA5_HUMAN (SEQ ID NO:420), which also corresponds to amino acids 1-682 of T51958_P1 (SEQ ID NO:423), and a second amino acid sequence being at least 70%, optionally at least 80%, preferably at least 85%, more preferably at least 90% and most preferably at least 95% homologous to a polypeptide having the sequence GMGWGGLCCTGSGGPRRLSPCTQPLCTEHGTEAIFVAAVGIRPSHHAAAQS (SEQ ID NO:618) corresponding to amino acids 683-733 of T51958_P1 (SEQ ID NO:423), wherein said first amino acid sequence and second amino acid sequence are contiguous and in a sequential order.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQPLCTEHGTEAIFVAAVGIRPSHHAAAQS (SEQ ID NO:618) of T51958_P1 (SEQ ID NO:423).

An isolated chimeric polypeptide encoding for T51958_P1 (SEQ ID NO:423), comprising a first amino acid sequence being at least 90% homologous to amino acids 1-682 of NP_690622 (SEQ ID NO:414), which also corresponds to amino acids 1-682 of T51958_P1 (SEQ ID NO:423), and a second amino acid sequence being at least 70%, optionally at least 80%, preferably at least 85%, more preferably at least 90% and most preferably at least 95% homologous to a polypeptide having the sequence GMGWGGLCCTGSGGPRRLSPCTQPLCTEHGTEAIFVAAVGIRPSHHAAAQS (SEQ ID NO:618) corresponding to amino acids 683-733 of T51958_P1 (SEQ ID NO:423), wherein said first amino acid sequence and second amino acid sequence are contiguous and in a sequential order.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQPLCTEHGTEAIFVAAVGIRPSHHAAAQS (SEQ ID NO:618) of T51958_P1 (SEQ ID NO:423).

An isolated chimeric polypeptide encoding for T51958_P1 (SEQ ID NO:423), comprising a first amino acid sequence being at least 90% homologous to amino acids 1-682 of NP_002812 (SEQ ID NO:413), which also corresponds to amino acids 1-682 of T51958_P1 (SEQ ID NO:423), and a second amino acid sequence being at least 70%, optionally at least 80%, preferably at least 85%, more preferably at least 90% and most preferably at least 95% homologous to a polypeptide having the sequence GMGWGGLCCTGSGGPRRLSPCTQPLCTEHGTEAIFVAAVGIRPSHHAAAQS (SEQ ID NO:618) corresponding to amino acids 683-733 of T51958_P1 (SEQ ID NO:423), wherein said first amino acid sequence and second amino acid sequence are contiguous and in a sequential order.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQPLCTEHGTEAIFVAAVGIRPSHHAAAQS (SEQ ID NO:618) of T51958_P1 (SEQ ID NO:423).

An isolated chimeric polypeptide encoding for T51958_P1 (SEQ ID NO:423), comprising a first amino acid sequence being at least 90% homologous to amino acids 1-92 of Q6IQ54_HUMAN (SEQ ID NO:419), which also corresponds to amino acids 1-92 of T51958_P1 (SEQ ID NO:423), a bridging amino acid L corresponding to amino acid 93 of T51958_P1 (SEQ ID NO:423), a second amino acid sequence being at least 90% homologous to amino acids 94-682 of Q6IQ54_HUMAN (SEQ ID NO:419), which also corresponds to amino acids 94-682 of T51958_P1 (SEQ ID NO:423), and a third amino acid sequence being at least 70%, optionally at least 80%, preferably at least 85%, more preferably at least 90% and most preferably at least 95% homologous to a polypeptide having the sequence GMGWGGLCCTGSGGPRRLSPCTQPLCTEHGTEAIFVAAVGIRPSHHAAAQS (SEQ ID NO:618) corresponding to amino acids 683-733 of T51958_P1 (SEQ ID NO:423), wherein said first amino acid sequence, bridging amino acid, second amino acid sequence and third amino acid sequence are contiguous and in a sequential order.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQPLCTEHGTEAIFVAAVGIRPSHHAAAQS (SEQ ID NO:618) of T51958_P1 (SEQ ID NO:423).

An isolated chimeric polypeptide encoding for T51958_P1 (SEQ ID NO:423), comprising a first amino acid sequence being at least 90% homologous to amino acids 1-499 of NP_690619 (SEQ ID NO:412), which also corresponds to amino acids 1-499 of T51958_P1 (SEQ ID NO:423), a second amino acid sequence being at least 70%, optionally at least 80%, preferably at least 85%, more preferably at least 90% and most preferably at least 95% homologous to a polypeptide having the sequence EKLKFTPPPQPQQCMEFDKEATVPCSATGREKPTIKWERA (SEQ ID NO:619) corresponding to amino acids 500-539 of T51958_P1 (SEQ ID NO:423), a third amino acid sequence being at least 90% homologous to amino acids 500-642 of NP_690619 (SEQ ID NO:412), which also corresponds to amino acids 540-682 of T51958_P1 (SEQ ID NO:423), and a fourth amino acid sequence being at least 70%, optionally at least 80%, preferably at least 85%, more preferably at least 90% and most preferably at least 95% homologous to a polypeptide having the sequence GMGWGGLCCTGSGGPRRLSPCTQPLCTEHGTEAIFVAAVGIRPSHHAAAQS (SEQ ID NO:618) corresponding to amino acids 683-733 of T51958_P1 (SEQ ID NO:423), wherein said first amino acid sequence, second amino acid sequence, third amino acid sequence and fourth amino acid sequence are contiguous and in a sequential order.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence EKLKFTPPPQPQQCMEFDKEATVPCSATGREKPTIKWERA (SEQ ID NO:619) of T51958_P1 (SEQ ID NO:423).

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQ-PLCTEHGTEAIFVAAVGIRPSHHAAAQS (SEQ ID NO:618) of T51958_P1 (SEQ ID NO:423).

An isolated chimeric polypeptide encoding for T51958_P1 (SEQ ID NO:423), comprising a first amino acid sequence being at least 90% homologous to amino acids 1-499 of Q8NFA8_HUMAN (SEQ ID NO:416), which also corresponds to amino acids 1-499 of T51958_P1 (SEQ ID NO:423), a second amino acid sequence being at least 70%, optionally at least 80%, preferably at least 85%, more preferably at least 90% and most preferably at least 95% homologous to a polypeptide having the sequence EKLKFTPP-PQPQQCMEFDKEATVPCSATGREKPTIKWERA (SEQ ID NO:619) corresponding to amino acids 500-539 of T51958_P1 (SEQ ID NO:423), a third amino acid sequence being at least 90% homologous to amino acids 500-642 of Q8NFA8_HUMAN (SEQ ID NO:416), which also corresponds to amino acids 540-682 of T51958_P1 (SEQ ID NO:423), and a fourth amino acid sequence being at least 70%, optionally at least 80%, preferably at least 85%, more preferably at least 90% and most preferably at least 95% homologous to a polypeptide having the sequence GMGWG-GLCCTGSGGPRRLSPCTQPLCTEH-GTEAIFVAAVGIRPSHHAAAQS (SEQ ID NO:618) corresponding to amino acids 683-733 of T51958_P1 (SEQ ID NO:423), wherein said first amino acid sequence, second amino acid sequence, third amino acid sequence and fourth amino acid sequence are contiguous and in a sequential order.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence EKLKFTPPPQPQQCMEFDKEATVPCSAT-GREKPTIKWERA (SEQ ID NO:619) of T51958_P1 (SEQ ID NO:423).

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQ-PLCTEHGTEAIFVAAVGIRPSHHAAAQS of T51958_P1 (SEQ ID NO:423).

An isolated chimeric polypeptide encoding for T51958_P1 (SEQ ID NO:423), comprising a first amino acid sequence being at least 90% homologous to amino acids 1-626 of Q8NFA6_HUMAN (SEQ ID NO:418), which also corresponds to amino acids 1-626 of T51958_P1 (SEQ ID NO:423), and a second amino acid sequence being at least 70%, optionally at least 80%, preferably at least 85%, more preferably at least 90% and most preferably at least 95% homologous to a polypeptide having the sequence GKDRILDPTKLGPRMHIFQNGSLVIHD-VAPEDSGRYTCIAGNSCNIKHTEAPLYVVGMGW GGLCCTGSGGPRRLSPCTQPLCTEH-GTEAIFVAAVGIRPSHHAAAQS (SEQ ID NO:620) corresponding to amino acids 627-733 of T51958_P1 (SEQ ID NO:423), wherein said first amino acid sequence and second amino acid sequence are contiguous and in a sequential order.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GKDRILDPTKLGPRMHIFQNGSLVIHD-VAPEDSGRYTCIAGNSCNIKHTEAPLYVVGMGW GGLCCTGSGGPRRLSPCTQPLCTEH-GTEAIFVAAVGIRPSHHAAAQS (SEQ ID NO:620) of T51958_P1 (SEQ ID NO:423).

An isolated chimeric polypeptide encoding for T51958_P1 (SEQ ID NO:423), comprising a first amino acid sequence being at least 90% homologous to amino acids 1-626 of NP_690621 (SEQ ID NO:410), which also corresponds to amino acids 1-626 of T51958_P1 (SEQ ID NO:423), and a second amino acid sequence being at least 70%, optionally at least 80%, preferably at least 85%, more preferably at least 90% and most preferably at least 95% homologous to a polypeptide having the sequence GKDRILDPTKLGPRM-HIFQNGSLVIHDVAPEDSGRYT-CIAGNSCNIKHTEAPLYVVGMGW GGLCCTGSGG-PRRLSPCTQPLCTEHGTEAIFVAAVGIRPSHHAAAQS (SEQ ID NO:620) corresponding to amino acids 627-733 of T51958_P1 (SEQ ID NO:423), wherein said first amino acid sequence and second amino acid sequence are contiguous and in a sequential order.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GKDRILDPTKLGPRMHIFQNGSLVIHD-VAPEDSGRYTCIAGNSCNIKHTEAPLYVVGMGW GGLCCTGSGGPRRLSPCTQPLCTEH-GTEAIFVAAVGIRPSHHAAAQS (SEQ ID NO:620) of T51958_P1 (SEQ ID NO:423).

An isolated chimeric polypeptide encoding for T51958_P1 (SEQ ID NO:423), comprising a first amino acid sequence being at least 90% homologous to amino acids 1-409 of Q8NFA7_HUMAN (SEQ ID NO:421), which also corresponds to amino acids 1-409 of T51958_P1 (SEQ ID NO:423), a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD (SEQ ID NO:621) corresponding to amino acids 410-540 of T51958_P1 (SEQ ID NO:423), a third amino acid sequence being at least 90% homologous to amino acids 411-552 of Q8NFA7_HUMAN (SEQ ID NO:421), which also corresponds to amino acids 541-682 of T51958_P1 (SEQ ID NO:423), and a fourth amino acid sequence being at least 70%, optionally at least 80%, preferably at least 85%, more preferably at least 90% and most preferably at least 95% homologous to a polypeptide having the sequence GMGWG-GLCCTGSGGPRRLSPCTQPLCTEH-GTEAIFVAAVGIRPSHHAAAQS (SEQ ID NO:618) corresponding to amino acids 683-733 of T51958_P1 (SEQ ID NO:423), wherein said first amino acid sequence, second amino acid sequence, third amino acid sequence and fourth amino acid sequence are contiguous and in a sequential order.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD (SEQ ID NO:621) of T51958_P1 (SEQ ID NO:423).

A bridge portion of T51958_P1 (SEQ ID NO:423), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AT, having a structure as follows (numbering according to T51958_P1): a sequence starting from any of amino acid numbers 409-x to 409; and ending at any of amino acid numbers 410+((n−2)−x), in which x varies from 0 to n−2.

A bridge portion of T51958_P1 (SEQ ID NO:423), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DG, having a structure as follows (numbering according to T51958_P1): a sequence starting from any of amino acid numbers 540-x to 540; and ending at any of amino acid numbers 541+((n−2)−x), in which x varies from 0 to n−2.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQ-PLCTEHGTEAIFVAAVGIRPSHHAAAQS (SEQ ID NO:618) of T51958_P1 (SEQ ID NO:423).

An isolated chimeric polypeptide encoding for T51958_P1 (SEQ ID NO:423), comprising a first amino acid sequence being at least 90% homologous to amino acids 1-409 of NP_690620 (SEQ ID NO:411), which also corresponds to amino acids 1-409 of T51958_P1 (SEQ ID NO:423), a second amino acid sequence being at least 70%, optionally at least 80%, preferably at least 85%, more preferably at least 90% and most preferably at least 95% homologous to a polypeptide having the sequence TVPSWLKKPQDSQLEE-GKPGYLDCLTQATPKPTVVWYRNQM-LISEDSRFEVFKNGTLRIN SVEVYDGTWYRC-MSSTPAGSIEAQARVQVLEKLKFTPPPQPQQCMEFDK EATVPCSATG REKPTIKWERAD (SEQ ID NO:621) corresponding to amino acids 410-540 of T51958_P1 (SEQ ID NO:423), a third amino acid sequence being at least 90% homologous to amino acids 411-552 of NP_690620 (SEQ ID NO:411), which also corresponds to amino acids 541-682 of T51958_P1 (SEQ ID NO:423), and a fourth amino acid sequence being at least 70%, optionally at least 80%, preferably at least 85%, more preferably at least 90% and most preferably at least 95% homologous to a polypeptide having the sequence GMGWGGLCCTGSGGPRRLSPCTQ-PLCTEHGTEAIFVAAVGIRPSHHAAAQS (SEQ ID NO:618) corresponding to amino acids 683-733 of T51958_P1 (SEQ ID NO:423), wherein said first amino acid sequence, second amino acid sequence, third amino acid sequence and fourth amino acid sequence are contiguous and in a sequential order.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD (SEQ ID NO:621) of T51958_P1 (SEQ ID NO:423).

A bridge portion of T51958_P1 (SEQ ID NO:423), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AT, having a structure as follows (numbering according to T51958_P1): a sequence starting from any of amino acid numbers 409-x to 409; and ending at any of amino acid numbers 410+((n−2)−x), in which x varies from 0 to n−2.

A bridge portion of T51958_P1 (SEQ ID NO:423), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DG, having a structure as follows (numbering according to T51958_P1): a sequence starting from any of amino acid numbers 540-x to 540; and ending at any of amino acid numbers 541+((n-2)-x), in which x varies from 0 to n-2.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQ-PLCTEHGTEAIFVAAVGIRPSHHAAAQS (SEQ ID NO:618) of T51958_P1 (SEQ ID NO:423).

An isolated chimeric polypeptide encoding for T51958_P1 (SEQ ID NO:423), comprising a first amino acid sequence being at least 90% homologous to amino acids 1-409 of Q86X91_HUMAN (SEQ ID NO:422), which also corresponds to amino acids 1-409 of T51958_P1 (SEQ ID NO:423), and a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERADGSS-LPEWVTDNAGTLHFARVTRDDAGNYTCIASNGPQGQ IRAHVQLT VAVFITFKVEPERT-TVYQGHTALLQCEAQGDPKPLI-QWKGKDRILDPTKLGPRMHIFQNG SLVIHDVAPEDS-GRYTCIAGNSCNIKHTEAPLYVVGMGWGGLCCTGSG GPRRLSPCTQPL CTEHGTEAIFVAAVGIRPSH-HAAAQS (SEQ ID NO:620) corresponding to amino acids 410-733 of T51958_P1 (SEQ ID NO:423), wherein said first amino acid sequence and second amino acid sequence are contiguous and in a sequential order.

An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLD-CLTQATPKPTWWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERADGSS-LPEWVTDNAGTLHFARVTRDDAGNYTCIASNGPQGQ IRAHVQLT VAVFITFKVEPERT-TVYQGHTALLQCEAQGDPKPLI-QWKGKDRILDPTKLGPRMHIFQNG SLVIHDVAPEDS-GRYTCIAGNSCNIKHTEAPLYVVGMGWGGLCCTGSG GPRRLSPCTQPL CTEHGTEAFFVAAVGIRPSH-HAAAQS (SEQ ID NO:622) of T51958_P1 (SEQ ID NO:423).

An isolated chimeric polypeptide encoding for T51958_P8 (SEQ ID NO:424), comprising a first amino acid sequence being at least 90% homologous to amino acids 1-91 of PTK7_HUMAN (SEQ ID NO:595), which also corresponds to amino acids 1-91 of T51958_P8 (SEQ ID NO:424), a bridging amino acid R corresponding to amino acid 92 of T51958_P8 (SEQ ID NO:424), a second amino acid sequence being at least 90% homologous to amino acids 93-146 of PTK7_HUMAN (SEQ ID NO:595), which also corresponds to amino acids 93-146 of T51958_P8 (SEQ ID NO:424), a bridging amino acid T corresponding to amino acid 147 of T51958_P8 (SEQ ID NO:424), a third amino acid sequence being at least 90% homologous to amino acids 148-206 of PTK7_HUMAN (SEQ ID NO:595), which also corresponds to amino acids 148-206 of T51958_P8 (SEQ ID NO:424), a bridging amino acid G corresponding to amino acid 207 of T51958_P8 (SEQ ID NO:424), a fourth amino acid sequence being at least 90% homologous to amino acids 208-494 of PTK7_HUMAN (SEQ ID NO:595), which also corresponds to amino acids 208-494 of T51958_P8 (SEQ ID NO:424), bridging amino acids RV corresponding to amino acid 495-496 of T51958_P8 (SEQ ID NO:424), a fifth amino acid sequence being at least 90% homologous to amino acids 497-514 of PTK7_HUMAN (SEQ ID NO:595), which also corresponds to amino acids 497-514 of T51958_P8 (SEQ ID NO:424), a bridging amino acid E corresponding to amino acid 515 of T51958_P8 (SEQ ID NO:424), a sixth amino acid sequence being at least 90% homologous to amino acids 516-641 of PTK7_HUMAN (SEQ ID NO:595), which also corresponds to amino acids 516-641 of T51958_P8 (SEQ ID NO:424), and a seventh amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence, bridging amino acid, second amino acid sequence, bridging amino acid, third amino acid sequence, bridging amino acid, fourth amino acid sequence, bridging amino acid, fifth amino acid sequence, bridging amino acid, sixth amino acid sequence and seventh amino acid sequence are contiguous and in a sequential order.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

An isolated chimeric polypeptide encoding for T51958_P8 (SEQ ID NO:424), comprising a first amino acid sequence being at least 90% homologous to amino acids 1-641 of NP_690622 (SEQ ID NO:414), which also corresponds to amino acids 1-641 of T51958_P8 (SEQ ID NO:424), and a second amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence and second amino acid sequence are contiguous and in a sequential order.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

An isolated chimeric polypeptide encoding for T51958_P8 (SEQ ID NO:424), comprising a first amino acid sequence being at least 90% homologous to amino acids 1-641 of Q8NFA5_HUMAN (SEQ ID NO:420), which also corresponds to amino acids 1-641 of T51958_P8 (SEQ ID NO:424), and a second amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence and second amino acid sequence are contiguous and in a sequential order.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

An isolated chimeric polypeptide encoding for T51958_P8 (SEQ ID NO:424), comprising a first amino acid sequence being at least 90% homologous to amino acids 1-641 of NP_002812 (SEQ ID NO:413), which also corresponds to amino acids 1-641 of T51958_P8 (SEQ ID NO:424), and a second amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence and second amino acid sequence are contiguous and in a sequential order.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

An isolated chimeric polypeptide encoding for T51958_P8 (SEQ ID NO:424), comprising a first amino acid sequence being at least 90% homologous to amino acids 1-92 of Q6IQ54_HUMAN (SEQ ID NO:419), which also corresponds to amino acids 1-92 of T51958_P8 (SEQ ID NO:424), a bridging amino acid L corresponding to amino acid 93 of T51958_P8 (SEQ ID NO:424), a second amino acid sequence being at least 90% homologous to amino acids 94-641 of Q6IQ54_HUMAN (SEQ ID NO:419), which also corresponds to amino acids 94-641 of T51958_P8 (SEQ ID NO:424), and a third amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence, bridging amino acid, second amino acid sequence and third amino acid sequence are contiguous and in a sequential order.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

An isolated chimeric polypeptide encoding for T51958_P8 (SEQ ID NO:424), comprising a first amino acid sequence being at least 90% homologous to amino acids 1-626 of NP_690621 (SEQ ID) NO:410), which also corresponds to amino acids 1-626 of T51958_P8 (SEQ ID NO:424), and a second amino acid sequence being at least 70%, optionally at least 80%, preferably at least 85%, more preferably at least 90% and most preferably at least 95% homologous to a polypeptide having the sequence GKDRILDPTKLGPRMAPW (SEQ ID NO:624) corresponding to amino acids 627-644 of T51958_P8 (SEQ ID NO:424), wherein said first amino acid sequence and second amino acid sequence are contiguous and in a sequential order.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence GKDRILDPTKLGPRMAPW (SEQ ID NO:624) of T51958_P8 (SEQ ID) NO:424).

An isolated chimeric polypeptide encoding for T51958_P8 (SEQ ID NO:424), comprising a first amino acid sequence being at least 90% homologous to amino acids 1-626 of Q8NFA6_HUMAN (SEQ ID NO:418), which also corresponds to amino acids 1-626 of T51958_P8 (SEQ ID NO:424), and a second amino acid sequence being at least 70%, optionally at least 80%, preferably at least 85%, more preferably at least 90% and most preferably at least 95% homologous to a polypeptide having the sequence GKDRILDPTKLGPRMAPW (SEQ ID NO:624) corresponding to amino acids 627-644 of T51958_P8 (SEQ ID NO:424), wherein said first amino acid sequence and second amino acid sequence are contiguous and in a sequential order.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence GKDRILDPTKLGPRMAPW (SEQ ID NO:624) of T51958_P8 (SEQ ID NO:424).

An isolated chimeric polypeptide encoding for T51958_P8 (SEQ ID NO:424), comprising a first amino acid sequence being at least 90% homologous to amino acids 1-499 of NP_690619 (SEQ ID NO:412), which also corresponds to amino acids 1-499 of T51958_P8 (SEQ ID NO:424), a second amino acid sequence being at least 70%, optionally at least 80%, preferably at least 85%, more preferably at least 90% and most preferably at least 95% homologous to a polypeptide having the sequence EKLKFTPPPQPQQCMEFDKEATVPCSATGREKPTIKWERA (SEQ ID NO:619) corresponding to amino acids 500-539 of T51958_P8 (SEQ ID NO:424), a third amino acid sequence being at least 90% homologous to amino acids 500-601 of NP_690619 (SEQ ID NO:412), which also corresponds to amino acids 540-641 of T51958_P8 (SEQ ID NO:424), and a fourth amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence, second amino acid sequence, third amino acid sequence and fourth amino acid sequence are contiguous and in a sequential order.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence EKLKFTPPPQPQQCMEFDKEATVPCSATGREKPTIKWERA (SEQ ID NO:619) of T51958_P8 (SEQ ID NO:424).

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

An isolated chimeric polypeptide encoding for T51958_P8 (SEQ ID NO:424), comprising a first amino acid sequence being at least 90% homologous to amino acids 1-499 of Q8NFA8_HUMAN (SEQ ID NO:416), which also corresponds to amino acids 1-499 of T51958_P8 (SEQ ID NO:424), a second amino acid sequence being at least 70%, optionally at least 80%, preferably at least 85%, more preferably at least 90% and most preferably at least 95% homologous to a polypeptide having the sequence EKLKFTPPPQPQQCMEFDKEATVPCSATGREKPTIKWERA (SEQ ID NO:619) corresponding to amino acids 500-539 of T51958_P8 (SEQ ID NO:424), a third amino acid sequence being at least 90% homologous to amino acids 500-601 of Q8NFA8_HUMAN (SEQ ID NO:416), which also corresponds to amino acids 540-641 of T51958_P8 (SEQ ID NO:424), and a fourth amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence, second amino acid sequence, third amino acid sequence and fourth amino acid sequence are contiguous and in a sequential order.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence EKLKFTPPPQPQQCMEFDKEATVPCSATGREKPTIKWERA (SEQ ID NO:619) of T51958_P8 (SEQ ID NO:424).

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

An isolated chimeric polypeptide encoding for T51958_P8 (SEQ ID NO:424), comprising a first amino acid sequence being at least 90% homologous to amino acids 1-409 of NP_690620 (SEQ ID NO:411), which also corresponds to amino acids 1-409 of T51958_P8 (SEQ ID NO:424), a second amino acid sequence being at least 70%, optionally at least 80%, preferably at least 85%, more preferably at least 90% and most preferably at least 95% homologous to a polypeptide having the sequence TVPSWLKKPQDSQLEE-GKPGYLDCLTQATPKPTVVWYRNQM-LISEDSRFEVFKNGTLRIN SVEVYDGTWYRC-MSSTPAGSIEAQARVQVLEKLKFTPPPQPQQCMEFDK EATVPCSATG REKPTIKWERAD (SEQ ID NO:621) corresponding to amino acids 410-540 of T51958_P8 (SEQ ID NO:424), a third amino acid sequence being at least 90% homologous to amino acids 411-511 of NP_690620 (SEQ ID NO:411), which also corresponds to amino acids 541-641 of T51958_P8 (SEQ ID NO:424), and a fourth amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence, second amino acid sequence, third amino acid sequence and fourth amino acid sequence are contiguous and in a sequential order.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD of T51958_P8 (SEQ ID NO:424).

A bridge portion of T51958_P8 (SEQ ID NO:424), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AT, having a structure as follows (numbering according to T51958_P8): a sequence starting from any of amino acid numbers 409-x to 409; and ending at any of amino acid numbers 410+((n-2)-x), in which x varies from 0 to n-2.

A bridge portion of T51958_P8 (SEQ ID NO:424), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DG, having a structure as follows (numbering according to T51958_P8): a sequence starting from any of amino acid numbers 540-x to 540; and ending at any of amino acid numbers 541+((n-2)-x), in which x varies from 0 to n-2.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

An isolated chimeric polypeptide encoding for T51958_P8 (SEQ ID NO:424), comprising a first amino acid sequence being at least 90% homologous to amino acids 1-409 of Q8NFA7_HUMAN (SEQ ID NO:421), which also corresponds to amino acids 1-409 of T51958_P8 (SEQ ID NO:424), a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD (SEQ ID NO:621) corresponding to amino acids 410-540 of T51958_P8 (SEQ ID NO:424), a third amino acid sequence being at least 90% homologous to amino acids 411-511 of Q8NFA7_HUMAN (SEQ ID NO:421), which also corresponds to amino acids 541-641 of T51958_P8 (SEQ ID NO:424), and a fourth amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence, second amino acid sequence, third amino acid sequence and fourth amino acid sequence are contiguous and in a sequential order.

An isolated polypeptide encoding for an edge portion of T51958_P8 (SEQ ID NO:424), comprising an amino acid sequence being at least 70%, optionally at least 80%, preferably at least about 85%, more preferably at least about 90% and most preferably at least about 95% homologous to the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD (SEQ ID NO:621) of T51958_P8 (SEQ ID NO:424).

A bridge portion of T51958_P8 (SEQ ID NO:424), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AT, having a structure as follows (numbering according to T51958_P8): a sequence starting from any of amino acid numbers 409-x to 409; and ending at any of amino acid numbers 410+((n-2)-x), in which x varies from 0 to n-2.

A bridge portion of T51958_P8 (SEQ ID NO:424), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DG, having a structure as follows (numbering according to T51958_P8): a sequence starting from any of amino acid numbers 540-x to 540; and ending at any of amino acid numbers 541+((n-2)-x), in which x varies from 0 to n-2.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

An isolated chimeric polypeptide encoding for T51958_P8 (SEQ ID NO:424), comprising a first amino acid sequence being at least 90% homologous to amino acids 1-409 of Q86X91_HUMAN (SEQ ID NO:422), which also corresponds to amino acids 1-409 of T51958_P8 (SEQ ID NO:424), and a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERADGSS-LPEWVTDNAGTLHFARVTRDDAGNYTCIASNGPQGQ IRAHVQLT VAVFITFKVEPERT-TVYQGHTALLQCEAQGDPKPLI-QWKGKDRILDPTKLGPRMAPW (SEQ ID NO:627) corresponding to amino acids 410-644 of T51958_P8 (SEQ ID NO:424), wherein said first amino acid sequence and second amino acid sequence are contiguous and in a sequential order.

An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERADGSS-LPEWVTDNAGTLHFARVTRDDAGNYTCIASNGPQGQ IRAHVQLT VAVFITFKVEPERT-TVYQGHTALLQCEAQGDPKPLI-QWKGKDRILDPTKLGPRMAPW (SEQ ID NO:627) of T51958_P8 (SEQ ID NO:424).

An isolated chimeric polypeptide encoding for T51958_P13 (SEQ ID NO:425), comprising a first amino acid sequence being at least 90% homologous to amino acids 1-91 of PTK7_HUMAN (SEQ ID NO:595), which also corresponds to amino acids 1-91 of T51958_P13 (SEQ ID NO:425), a bridging amino acid R corresponding to amino acid 92 of T51958_P13 (SEQ ID NO:425), a second amino acid sequence being at least 90% homologous to amino acids 93-146 of PTK7_HUMAN (SEQ ID NO:595), which also corresponds to amino acids 93-146 of T51958_P13 (SEQ ID NO:425), a bridging amino acid T corresponding to amino acid 147 of T51958_P13 (SEQ ID NO:425), a third amino acid sequence being at least 90% homologous to amino acids 148-206 of PTK7_HUMAN (SEQ ID NO:595), which also corresponds to amino acids 148-206 of T51958_P13 (SEQ ID NO:425), a bridging amino acid G corresponding to amino acid 207 of T51958_P13 (SEQ ID NO:425), a fourth amino acid sequence being at least 90% homologous to amino acids 208-409 of PTK7_HUMAN (SEQ ID NO:595), which also corresponds to amino acids 208-409 of T51958_P13 (SEQ ID NO:425), a fifth bridging amino acid sequence comprising of N, a sixth amino acid sequence being at least 90% homologous to amino acids 541-880 of PTK7_HUMAN (SEQ ID NO:595), which also corresponds to amino acids 411-750 of T51958_P13 (SEQ ID NO:425), a bridging amino acid G corresponding to amino acid 751 of T51958_P13 (SEQ ID NO:425), a seventh amino acid sequence being at least 90% homologous to amino acids 882-968 of PTK7_HUMAN (SEQ ID NO:595), which also corresponds to amino acids 752-838 of T51958_P13 (SEQ ID NO:425), a bridging amino acid P corresponding to amino acid 839 of T51958_P13 (SEQ ID NO:425), a eighth amino acid sequence being at least 90% homologous to amino acids 970-991 of PTK7_HUMAN (SEQ ID NO:595), which also corresponds to amino acids 840-861 of T51958_P13 (SEQ ID NO:425), a bridging amino acid F corresponding to amino acid 862 of T51958_P13 (SEQ ID NO:425), and a nineth amino acid sequence being at least 90% homologous to amino acids 993-1070 of PTK7_HUMAN (SEQ ID NO:595), which also corresponds to amino acids 863-940 of T51958_P13 (SEQ ID NO:425), wherein said first amino acid sequence, bridging amino acid, second amino acid sequence, bridging amino acid, third amino acid sequence, bridging amino acid, fourth amino acid sequence, fifth amino acid sequence, sixth amino acid sequence, bridging amino acid, seventh amino acid sequence, bridging amino acid, eighth amino acid sequence, bridging amino acid and nineth amino acid sequence are contiguous and in a sequential order.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

An isolated chimeric polypeptide encoding for T51958_P13 (SEQ ID NO:425), comprising a first amino acid sequence being at least 90% homologous to amino acids 1-409 of NP_690619 (SEQ ID NO:412), which also corresponds to amino acids 1-409 of T51958_P13 (SEQ ID NO:425), a second bridging amino acid sequence comprising of N, and a third amino acid sequence being at least 90% homologous to amino acids 501-1030 of NP_690619 (SEQ ID NO:412), which also corresponds to amino acids 411-940 of T51958_P13 (SEQ ID NO:425), wherein said first amino acid sequence, second amino acid sequence and third amino acid sequence are contiguous and in a sequential order.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

An isolated chimeric polypeptide encoding for T51958_P13 (SEQ ID NO:425), comprising a first amino acid sequence being at least 90% homologous to amino acids 1-409 of Q8NFA8_HUMAN (SEQ ID NO:416), which also corresponds to amino acids 1-409 of T51958_P13 (SEQ ID NO:425), a second bridging amino acid sequence comprising of N, and a third amino acid sequence being at least 90% homologous to amino acids 501-1030 of Q8NFA8_HUMAN (SEQ ID NO:416), which also corresponds to amino acids 411-940 of T51958_P13 (SEQ ID NO:425), wherein said first amino acid sequence, second amino acid sequence and third amino acid sequence are contiguous and in a sequential order.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

An isolated chimeric polypeptide encoding for T51958_P13 (SEQ ID NO:425), comprising a first amino acid sequence being at least 90% homologous to amino acids 1-409 of NP_002812 (SEQ ID NO:413), which also corresponds to amino acids 1-409 of T51958_P13 (SEQ ID NO:425), a second bridging amino acid sequence comprising of N, and a third amino acid sequence being at least 90% homologous to amino acids 541-1070 of NP_002812 (SEQ ID NO:413), which also corresponds to amino acids 411-940 of T51958_P13 (SEQ ID NO:425), wherein said first amino acid sequence, second amino acid sequence and third amino acid sequence are contiguous and in a sequential order.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

An isolated chimeric polypeptide encoding for T51958_P13 (SEQ ID NO:425), comprising a first amino acid sequence being at least 90% homologous to amino acids 1-92 of Q6IQ54_HUMAN (SEQ ID NO:419), which also corresponds to amino acids 1-92 of T51958_P13 (SEQ ID NO:425), a bridging amino acid L corresponding to amino acid 93 of T51958_P13 (SEQ ID NO:425), a second amino acid sequence being at least 90% homologous to amino acids 94-409 of Q6IQ54_HUMAN (SEQ ID NO:419), which also corresponds to amino acids 94-409 of T51958_P13 (SEQ ID NO:425), a third bridging amino acid sequence comprising of N, and a fourth amino acid sequence being at least 90% homologous to amino acids 541-1070 of Q6IQ54_HUMAN (SEQ ID NO:419), which also corresponds to amino acids 411-940 of T51958_P13 (SEQ ID NO:425), wherein said first amino acid sequence, bridging amino acid, second amino acid sequence, third amino acid sequence and fourth amino acid sequence are contiguous and in a sequential order.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

An isolated chimeric polypeptide encoding for T51958_P13 (SEQ ID NO:425), comprising a first amino acid sequence being at least 90% homologous to amino acids 1-409 of Q8NFA6_HUMAN (SEQ ID NO:418), which also corresponds to amino acids 1-409 of T51958_P13 (SEQ ID NO:425), a second bridging amino acid sequence comprising of N, a third amino acid sequence being at least 90% homologous to amino acids 541-626 of Q8NFA6_HUMAN (SEQ ID NO:418), which also corresponds to amino acids 411-496 of T51958_P13 (SEQ ID NO:425), a fourth amino acid sequence being at least 70%, optionally at least 80%, preferably at least 85%, more preferably at least 90% and most preferably at least 95% homologous to a polypeptide having the sequence GKDRILDPTKLGPRMHIFQNGSLVIHD-VAPEDSGRYTCIAGNSCNIKHTEAPLYVV (SEQ ID NO:628) corresponding to amino acids 497-552 of T51958_P13 (SEQ ID NO:425), and a fifth amino acid sequence being at least 90% homologous to amino acids 627-1014 of Q8NFA6_HUMAN (SEQ ID NO:418), which also corresponds to amino acids 553-940 of T51958_P13 (SEQ ID NO:425), wherein said first amino acid sequence, second amino acid sequence, third amino acid sequence, fourth amino acid sequence and fifth amino acid sequence are contiguous and in a sequential order.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

An isolated polypeptide encoding for an edge portion of T51958_P13 (SEQ ID NO:425), comprising an amino acid sequence being at least 70%, optionally at least about 80%, preferably at least about 85%, more preferably at least about 90% and most preferably at least about 95% homologous to the sequence GKDRILDPTKLGPRMHIFQNGSLVIHD-VAPEDSGRYTCIAGNSCNIKHTEAPLYVV (SEQ ID NO:628) of T51958_P13 (SEQ ID NO:425).

An isolated chimeric polypeptide encoding for T51958_P13 (SEQ ID NO:425), comprising a first amino acid sequence being at least 90% homologous to amino acids 1-409 of NP_690621 (SEQ ID NO:410), which also corresponds to amino acids 1-409 of T51958_P13 (SEQ ID NO:425), a second bridging amino acid sequence comprising of N, a third amino acid sequence being at least 90% homologous to amino acids 541-626 of NP_690621 (SEQ ID NO:410), which also corresponds to amino acids 411-496 of T51958_P13 (SEQ ID NO:425), a fourth amino acid sequence being at least 70%, optionally at least 80%, preferably at least 85%, more preferably at least 90% and most preferably at least 95% homologous to a polypeptide having the sequence GKDRILDPTKLGPRMHIFQNGSLVIHD-VAPEDSGRYTCIAGNSCNIKHTEAPLYVV (SEQ ID NO:628) corresponding to amino acids 497-552 of T51958_P13 (SEQ ID NO:425), and a fifth amino acid sequence being at least 90% homologous to amino acids 627-1014 of NP_690621 (SEQ ID NO:410), which also corresponds to amino acids 553-940 of T51958_P13 (SEQ ID NO:425), wherein said first amino acid sequence, second amino acid sequence, third amino acid sequence, fourth amino acid sequence and fifth amino acid sequence are contiguous and in a sequential order.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

An isolated polypeptide encoding for an edge portion of T51958_P13 (SEQ ID NO:425), comprising an amino acid sequence being at least 70%, optionally at least about 80%, preferably at least about 85%, more preferably at least about 90% and most preferably at least about 95% homologous to the sequence GKDRILDPTKLGPRMHIFQNGSLVIHD-VAPEDSGRYTCIAGNSCNIKHTEAPLYVV (SEQ ID NO:628) of T51958_P13 (SEQ ID NO:425).

An isolated chimeric polypeptide encoding for T51958_P13 (SEQ ID NO:425), comprising a first amino acid sequence being at least 90% homologous to amino acids 1-409 of NP_690622 (SEQ ID NO:414), which also corresponds to amino acids 1-409 of T51958_P13 (SEQ ID NO:425), a second bridging amino acid sequence comprising of N, a third amino acid sequence being at least 90% homologous to amino acids 541-803 of NP_690622 (SEQ ID NO:414), which also corresponds to amino acids 411-673 of T51958_P13 (SEQ ID NO:425), and a fourth amino acid sequence being at least 70%, optionally at least 80%, preferably at least 85%, more preferably at least 90% and most preferably at least 95% homologous to a polypeptide having the sequence KSEFGEVFLAKAQGLEEGVAETLVLVK-SLQSKDEQQQLDFRRELEMFGKLNHANVVRLL GLCREAEPHYMVLEYVDLGDLKQFL-RISKSKDEKLKSQPLSTKQKVALCTQVALGMEHL SNNRFVHKDLAARNCLVSAQRQVKVSAL-GLSKDVYNSEYYHFRQAWVPLRWMSPEAIL EGDF-STKSDVWAFGVLMWEVFTHGEMPHG-GQADDEVLADLQAGKARLPQPEGCPSKLY RLMQRCWALSPKDRPSFSEIASALGDSTVDSKP (SEQ ID NO:629) corresponding to amino acids 674-940 of T51958_P13 (SEQ ID NO:425), wherein said first amino acid sequence, second amino acid sequence, third amino acid sequence and fourth amino acid sequence are contiguous and in a sequential order.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

An isolated polypeptide encoding for an edge portion of T51958_P13 (SEQ ID NO:425), comprising an amino acid sequence being at least 70%, optionally at least about 80%, preferably at least about 85%, more preferably at least about 90% and most preferably at least about 95% homologous to the sequence KSEFGEVFLAKAQGLEEGVAETLVLVK-SLQSKDEQQQLDFRRELEMFGKLNHANVVRLL GLCREAEPHYMVLEYVDLGDLKQFL-RISKSKDEKLKSQPLSTKQKVALCTQVALGMEHL SNNRFVHKDLAARNCLVSAQRQVKVSAL-GLSKDVYNSEYYHFRQAWVPLRWMSPEAIL EGDF-STKSDVWAFGVLMWEVFTHGEMPHG-GQADDEVLADLQAGKARLPQPEGCPSKLY RLMQRCWALSPKDRPSFSEIASALGDSTVDSKP (SEQ ID NO:629) of T51958_P13 (SEQ ID NO:425).

An isolated chimeric polypeptide encoding for T51958_P13 (SEQ ID NO:425), comprising a first amino acid sequence being at least 90% homologous to amino acids 1-409 of Q8NFA5_HUMAN (SEQ ID NO:420), which also corresponds to amino acids 1-409 of T51958_P13 (SEQ ID NO:425), a second bridging amino acid sequence comprising of N, a third amino acid sequence being at least 90% homologous to amino acids 541-803 of Q8NFA5_HUMAN (SEQ ID NO:420), which also corresponds to amino acids 411-673 of T51958_P13 (SEQ ID NO:425), and a fourth amino acid sequence being at least 70%, optionally at least 80%, preferably at least 85%, more preferably at least 90% and most preferably at least 95% homologous to a polypeptide having the sequence KSEFGEVFLAKAQGLEEGVAETLVLVK-SLQSKDEQQQLDFRRELEMFGKLNHANVVRLL GLCREAEPHYMVLEYVDLGDLKQFL-RISKSKDEKLKSQPLSTKQKVALCTQVALGMEHL SNNRFVHKDLAARNCLVSAQRQVKVSAL-GLSKDVYNSEYYHFRQAWVPLRWMSPEAIL EGDF-STKSDVWAFGVLMWEVFTHGEMPHG-GQADDEVLADLQAGKARLPQPEGCPSKLY RLMQRCWALSPKDRPSFSEIASALGDSTVDSKP (SEQ ID NO:629) corresponding to amino acids 674-940 of T51958_P13 (SEQ ID NO:425), wherein said first amino acid sequence, second amino acid sequence, third amino acid sequence and fourth amino acid sequence are contiguous and in a sequential order.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

An isolated polypeptide encoding for an edge portion of T51958_P13 (SEQ ID NO:425), comprising an amino acid sequence being at least 70%, optionally at least about 80%, preferably at least about 85%, more preferably at least about 90% and most preferably at least about 95% homologous to the sequence KSEFGEVFLAKAQGLEEGVAETLVLVK-SLQSKDEQQQLDFRRELEMFGKLNHANVVRLL GLCREAEPHYMVLEYVDLGDLKQFL-RISKSKDEKLKSQPLSTKQKVALCTQVALGMEHL SNNRFVHKDLAARNCLVSAQRQVKVSAL-GLSKDVYNSEYYHFRQAWVPLRWMSPEAIL EGDF-STKSDVWAFGVLMWEVFTHGEMPHG-GQADDEVLADLQAGKARLPQPEGCPSKLY RLMQRCWALSPKDRPSFSEIASALGDSTVDSKP (SEQ ID NO:629) of T51958_P13 (SEQ ID NO:425).

An isolated chimeric polypeptide encoding for T51958_P27 (SEQ ID NO:426), comprising a first amino acid sequence being at least 90% homologous to amino acids 1-409 of NP_690622 (SEQ ID NO:414), which also corresponds to amino acids 1-409 of T51958_P27 (SEQ ID NO:426), and a second amino acid sequence being at least 70%, optionally at least 80%, preferably at least 85%, more preferably at least 90% and most preferably at least 95% homologous to a polypeptide having the sequence SEHL-CPEGQGEVEGNTGLGVMDRGFPGTHL-RSSQFWALQAWESVHYWESV (SEQ ID NO:630) corresponding to amino acids 410-459 of T51958_P27 (SEQ ID NO:426), wherein said first amino acid sequence and second amino acid sequence are contiguous and in a sequential order.

An isolated polypeptide encoding for an edge portion of T51958_P27 (SEQ ID NO:426), comprising an amino acid sequence being at least 70%, optionally at least about 80%, preferably at least about 85%, more preferably at least about 90% and most preferably at least about 95% homologous to the sequence SEHLCPEGQGEVEGNTGLGVMDRGF-PGTHLRSSQFWALQAWESVHYWESV (SEQ ID NO:630) of T51958_P27 (SEQ ID NO:426).

An isolated chimeric polypeptide encoding for T51958_P27 (SEQ ID NO:426), comprising a first amino acid sequence being at least 90% homologous to amino acids 1-409 of Q8NFA5_HUMAN (SEQ ID NO:420), which also corresponds to amino acids 1-409 of T51958_P27 (SEQ ID NO:426), and a second amino acid sequence being at least 70%, optionally at least 80%, preferably at least 85%, more preferably at least 90% and most preferably at least 95% homologous to a polypeptide having the sequence SEHL-CPEGQGEVEGNTGLGVMDRGFPGTHL-RSSQFWALQAWESVHYWESV (SEQ ID NO:630) corresponding to amino acids 410-459 of T51958_P27 (SEQ ID NO:426), wherein said first amino acid sequence and second amino acid sequence are contiguous and in a sequential order.

An isolated polypeptide encoding for an edge portion of T51958_P27 (SEQ ID NO:426), comprising an amino acid sequence being at least 70%, optionally at least about 80%, preferably at least about 85%, more preferably at least about 90% and most preferably at least about 95% homologous to the sequence SEHLCPEGQGEVEGNTGLGVMDRGF-PGTHLRSSQFWALQAWESVHYWESV (SEQ ID NO:630) of T51958_P27 (SEQ ID NO:426).

An isolated chimeric polypeptide encoding for T51958_P5 (SEQ ID NO:633), comprising a first amino acid sequence being at least 90% homologous to amino acids 1-91 of PTK7_HUMAN (SEQ ID NO:595), which also corresponds to amino acids 1-91 of T51958_P5 (SEQ ID NO:633), a bridging amino acid R corresponding to amino acid 92 of T51958_P5 (SEQ ID NO:633), a second amino acid sequence being at least 90% homologous to amino acids 93-146 of PTK7_HUMAN (SEQ ID NO:595), which also corresponds to amino acids 93-146 of T51958_P5 (SEQ ID NO:633), a bridging amino acid T corresponding to amino acid 147 of T51958_P5 (SEQ ID NO:633), a third amino acid sequence being at least 90% homologous to amino acids 148-206 of PTK7_HUMAN (SEQ ID NO:595), which also corresponds to amino acids 148-206 of T51958_P5 (SEQ ID NO:633), a bridging amino acid G corresponding to amino acid 207 of T51958_P5 (SEQ ID NO:633), a fourth amino acid sequence being at least 90% homologous to amino acids 208-494 of PTK7_HUMAN (SEQ ID NO:595), which also corresponds to amino acids 208-494 of T51958_P5 (SEQ ID NO:633), bridging amino acids RV corresponding to amino acid 495-496 of T51958_P5 (SEQ ID NO:633), a fifth amino acid sequence being at least 90% homologous to amino acids 497-514 of PTK7_HUMAN (SEQ ID NO:595), which also corresponds to amino acids 497-514 of T51958_P5 (SEQ ID NO:633), a bridging amino acid E corresponding to amino acid 515 of T51958_P5 (SEQ ID NO:633), a sixth amino acid sequence being at least 90% homologous to amino acids 516-751 of PTK7_HUMAN (SEQ ID NO:595), which also corresponds to amino acids 516-751 of T51958_P5 (SEQ ID NO:633), and a seventh amino acid sequence being at least 70%, optionally at least 80%, preferably at least 85%, more preferably at least 90% and most preferably at least 95% homologous to a polypeptide having the sequence EGPWT-GRWCPCAGAERPPAATEGRAPALWKPS-GCCWVLELGLPHP (SEQ ID NO:634) corresponding to amino acids 752-796 of T51958_P5 (SEQ ID NO:633), wherein said first amino acid sequence, bridging amino acid, second amino acid sequence, bridging amino acid, third amino acid sequence, bridging amino acid, fourth amino acid sequence, bridging amino acid, fifth amino acid sequence, bridging amino acid, sixth amino acid sequence and seventh amino acid sequence are contiguous and in a sequential order.

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRA-PALWKPSGCCWVLELGLPHP (SEQ ID NO:634) of T51958_P5 (SEQ ID NO:633).

An isolated chimeric polypeptide encoding for T51958_P5 (SEQ ID NO:633), comprising a first amino acid sequence being at least 90% homologous to amino acids 1-751 of Q8NFA5_HUMAN, which also corresponds to amino acids 1-751 of T51958_P5 (SEQ ID NO:633), and a second amino acid sequence being at least 70%, optionally at least 80%, preferably at least 85%, more preferably at least 90% and most preferably at least 95% homologous to a polypeptide having the sequence EGPWTGRWCPCAGAERPPAATE-GRAPALWKPSGCCWVLELGLPHP (SEQ ID NO:634) corresponding to amino acids 752-796 of T51958_P5 (SEQ ID NO:633), wherein said first amino acid sequence and second amino acid sequence are contiguous and in a sequential order.

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRA-PALWKPSGCCWVLELGLPHP (SEQ ID NO:634) of T51958_P5 (SEQ ID NO:633).

An isolated chimeric polypeptide encoding for T51958_P5 (SEQ ID NO:633), comprising a first amino acid sequence being at least 90% homologous to amino acids 1-751 of NP_690622, which also corresponds to amino acids 1-751 of T51958_P5 (SEQ ID NO:633), and a second amino acid sequence being at least 70%, optionally at least 80%, preferably at least 85%, more preferably at least 90% and most preferably at least 95% homologous to a polypeptide having the sequence EGPWTGRWCPCAGAERPPAATEGRA-PALWKPSGCCWVLELGLPHP (SEQ ID NO:634) corresponding to amino acids 752-796 of T51958_P5 (SEQ ID NO:633), wherein said first amino acid sequence and second amino acid sequence are contiguous and in a sequential order.

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRA-PALWKPSGCCWVLELGLPHP (SEQ ID NO:634) of T51958_P5 (SEQ ID NO:633).

An isolated chimeric polypeptide encoding for T51958_P5 (SEQ ID NO:633), comprising a first amino acid sequence being at least 90% homologous to amino acids 1-751 of NP_002812, which also corresponds to amino acids 1-751 of T51958_P5 (SEQ ID NO:633), and a second amino acid sequence being at least 70%, optionally at least 80%, preferably at least 85%, more preferably at least 90% and most preferably at least 95% homologous to a polypeptide having the sequence EGPWTGRWCPCAGAERPPAATEGRA-PALWKPSGCCWVLELGLPHP (SEQ ID NO:634) corresponding to amino acids 752-796 of T51958_P5 (SEQ ID NO:633), wherein said first amino acid sequence and second amino acid sequence are contiguous and in a sequential order.

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRA-PALWKPSGCCWVLELGLPHP (SEQ ID NO:634) of T51958_P5 (SEQ ID NO:633).

An isolated chimeric polypeptide encoding for T51958_P5 (SEQ ID NO:633), comprising a first amino acid sequence being at least 90% homologous to amino acids 1-92 of Q6IQ54_HUMAN, which also corresponds to amino acids 1-92 of T51958_P5 (SEQ ID NO:633), a bridging amino acid L corresponding to amino acid 93 of T51958_P5 (SEQ ID NO:633), a second amino acid sequence being at least 90% homologous to amino acids 94-751 of Q6IQ54_HUMAN, which also corresponds to amino acids 94-751 of T51958_P5

(SEQ ID NO:633), and a third amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence, bridging amino acid, second amino acid sequence and third amino acid sequence are contiguous and in a sequential order.

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

An isolated chimeric polypeptide encoding for T51958_P5 (SEQ ID NO:633), comprising a first amino acid sequence being at least 90% homologous to amino acids 1-499 of NP_690619, which also corresponds to amino acids 1-499 of T51958_P5 (SEQ ID NO:633), a second amino acid sequence being at least 70%, optionally at least 80%, preferably at least 85%, more preferably at least 90% and most preferably at least 95% homologous to a polypeptide having the sequence EKLKFTPPPQPQQCMEFDKEATVPCSATGREKPTIKWERA (SEQ ID NO:619) corresponding to amino acids 500-539 of T51958_P5 (SEQ ID NO:633), a third amino acid sequence being at least 90% homologous to amino acids 500-711 of NP_690619, which also corresponds to amino acids 540-751 of T51958_P5 (SEQ ID NO:633), and a fourth amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence, second amino acid sequence, third amino acid sequence and fourth amino acid sequence are contiguous and in a sequential order.

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EKLKFTPPPQPQQCMEFDKEATVPCSATGREKPTIKWERA (SEQ ID NO:619) of T51958_P5 (SEQ ID NO:633).

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

An isolated chimeric polypeptide encoding for T51958_P5 (SEQ ID NO:633), comprising a first amino acid sequence being at least 90% homologous to amino acids 1-499 of Q8NFA8_HUMAN, which also corresponds to amino acids 1-499 of T51958_P5 (SEQ ID NO:633), a second amino acid sequence being at least 70%, optionally at least 80%, preferably at least 85%, more preferably at least 90% and most preferably at least 95% homologous to a polypeptide having the sequence EKLKFTPPPQPQQCMEFDKEATVPCSATGREKPTIKWERA (SEQ ID NO:619) corresponding to amino acids 500-539 of T51958_P5 (SEQ ID NO:633), a third amino acid sequence being at least 90% homologous to amino acids 500-711 of Q8NFA8_HUMAN, which also corresponds to amino acids 540-751 of T51958_P5 (SEQ ID NO:633), and a fourth amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence, second amino acid sequence, third amino acid sequence and fourth amino acid sequence are contiguous and in a sequential order.

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EKLKFTPPPQPQQCMEFDKEATVPCSATGREKPTIKWERA (SEQ ID NO:619) of T51958_P5 (SEQ ID NO:633).

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

An isolated chimeric polypeptide encoding for T51958_P5 (SEQ ID NO:633), comprising a first amino acid sequence being at least 90% homologous to amino acids 1-626 of Q8NFA6_HUMAN, which also corresponds to amino acids 1-626 of T51958_P5 (SEQ ID NO:633), a second amino acid sequence being at least 70%, optionally at least 80%, preferably at least 85%, more preferably at least 90% and most preferably at least 95% homologous to a polypeptide having the sequence GKDRILDPTKLGPRMHIFQNGSLVIHDVAPEDSGRYTCIAGNSCNIKHTEAPLYVV (SEQ ID NO:628) corresponding to amino acids 627-682 of T51958_P5 (SEQ ID NO:633), a third amino acid sequence being at least 90% homologous to DKPVPEESEGPGSPPPYKMIQTIGLSVGAAVAYIIAVLGLMFYCKKRCKAKRLQKQPEGEE PEMECLNG corresponding to amino acids 627-695 of Q8NFA6_HUMAN, which also corresponds to amino acids 683-751 of T51958_P5 (SEQ ID NO:633), and a fourth amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence, second amino acid sequence, third amino acid sequence and fourth amino acid sequence are contiguous and in a sequential order.

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence GKDRILDPTKLGPRMHIFQNGSLVIHDVAPEDSGRYTCIAGNSCNIKHTEAPLYVV (SEQ ID NO:628) of T51958_P5 (SEQ ID NO:633).

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

An isolated chimeric polypeptide encoding for T51958_P5 (SEQ ID NO:633), comprising a first amino acid sequence being at least 90% homologous to amino acids 1-626 of NP_690621, which also corresponds to amino acids 1-626 of T51958_P5 (SEQ ID NO:633), a second amino acid sequence being at least 70%, optionally at least 80%, preferably at least 85%, more preferably at least 90% and most preferably at least 95% homologous to a polypeptide having the sequence GKDRILDPTKLGPRMHIFQNGSLVIHDVAPEDSGRYTCIAGNSCNIKHTEAPLYVV (SEQ ID NO:628) corresponding to amino acids 627-682 of T51958_P5 (SEQ ID NO:633), a third amino acid sequence being at least 90% homologous to amino acids 627-695 of NP_690621, which also corresponds to amino acids 683-751 of T51958_P5 (SEQ ID NO:633), and a fourth amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence, second amino acid sequence, third amino acid sequence and fourth amino acid sequence are contiguous and in a sequential order.

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence GKDRILDPTKLGPRMHIFQNGSLVIHDVAPEDSGRYTCIAGNSCNIKHTEAPLYVV (SEQ ID NO:628) of T51958_P5 (SEQ ID NO:633).

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

An isolated chimeric polypeptide encoding for T51958_P5 (SEQ ID NO:633), comprising a first amino acid sequence being at least 90% homologous to amino acids 1-409 of Q8NFA7_HUMAN, which also corresponds to amino acids 1-409 of T51958_P5 (SEQ ID NO:633), a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLDCLTQATPKPTVVWYRNQMLISEDSRFEVFKNGTLRINSVEVYDGTWYRCMSSTPAG-SIEAQARVQVLEKLKFTPPPQPQQC-MEFDKEATVPCSATG REKPTIKWERAD (SEQ ID NO:621) corresponding to amino acids 410-540 of T51958_P5 (SEQ ID NO:633), a third amino acid sequence being at least 90% homologous to amino acids 411-621 of Q8NFA7_HUMAN, which also corresponds to amino acids 541-751 of T51958_P5 (SEQ ID NO:633), and a fourth amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence, second amino acid sequence, third amino acid sequence and fourth amino acid sequence are contiguous and in a sequential order.

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLDCLTQATPKPTVVWYRNQMLISEDSRFEVFKNGTLRINSVEVYDGTWYRCMSSTPAG-SIEAQARVQVLEKLKFTPPPQPQQC-MEFDKEATVPCSATG REKPTIKWERAD (SEQ ID NO:621) of T51958_P5 (SEQ ID NO:633).

A bridge portion of T51958_P5 (SEQ ID NO:633), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AT, having a structure as follows (numbering according to T51958_P5 (SEQ ID NO:633)): a sequence starting from any of amino acid numbers 409-x to 409; and ending at any of amino acid numbers 410+((n-2)-x), in which x varies from 0 to n-2.

A bridge portion of T51958_P5 (SEQ ID NO:633), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DG, having a structure as follows (numbering according to T51958_P5 (SEQ ID NO:633)): a sequence starting from any of amino acid numbers 540-x to 540; and ending at any of amino acid numbers 541+((n-2)-x), in which x varies from 0 to n-2.

An isolated polypeptide encoding for an edge portion of T51958_P5 (SEQ ID NO:633), comprising an amino acid sequence being at least 70%, optionally at least about 80%, preferably at least 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

An isolated chimeric polypeptide encoding for T51958_P5 (SEQ ID NO:633), comprising a first amino acid sequence being at least 90% homologous to amino acids 1-409 of NP_690620, which also corresponds to amino acids 1-409 of T51958_P5 (SEQ ID NO:633), a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLDCLTQATPKPTVVWYRNQMLISEDSRFEVFKNGTLRINSVEVYDGTWYRCMSSTPAG-SIEAQARVQVLEKLKFTPPPQPQQC-MEFDKEATVPCSATG REKPTIKWERAD (SEQ ID NO:621) corresponding to amino acids 410-540 of T51958_P5 (SEQ ID NO:633), a third amino acid sequence being at least 90% homologous to amino acids 411-621 of NP_690620, which also corresponds to amino acids 541-751 of T51958_P5 (SEQ ID NO:633), and a fourth amino acid sequence being at least 70%, optionally at least 80%, preferably at least 85%, more preferably at least 90% and most preferably at least 95% homologous to a polypeptide having the sequence EGPWTGRWCPCAGAERPPAATEGRA-PALWKPSGCCWVLELGLPHP (SEQ ID NO:634) corresponding to amino acids 752-796 of T51958_P5 (SEQ ID NO:633), wherein said first amino acid sequence, second amino acid sequence, third amino acid sequence and fourth amino acid sequence are contiguous and in a sequential order.

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKIWERAD (SEQ ID NO:621) of T51958_P5 (SEQ ID NO:633).

A bridge portion of T51958_P5 (SEQ ID NO:633), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AT, having a structure as follows (numbering according to T51958_P5 (SEQ ID NO:633)): a sequence starting from any of amino acid numbers 409-x to 409; and ending at any of amino acid numbers 410+((n-2)-x), in which x varies from 0 to n-2.

A bridge portion of T51958_P5 (SEQ ID NO:633), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DG, having a structure as follows (numbering according to T51958_P5 (SEQ ID NO:633)): a sequence starting from any of amino acid numbers 540-x to 540; and ending at any of amino acid numbers 541+((n-2)-x), in which x varies from 0 to n-2.

An isolated polypeptide encoding for an edge portion of T51958_P5 (SEQ ID NO:633), comprising an amino acid sequence being at least 70%, optionally at least 80%, preferably at least about 85%, more preferably at least about 90% and most preferably at least about 95% homologous to the sequence EGPWTGRWCPCAGAERPPAATEGRA-PALWKPSGCCWVLELGLPHP (SEQ ID NO:634) of T51958_P5 (SEQ ID NO:633).

An isolated chimeric polypeptide encoding for T51958_P5 (SEQ ID NO:633), comprising a first amino acid sequence being at least 90% homologous to amino acids 1-409 of Q86X91_HUMAN, which also corresponds to amino acids 1-409 of T51958_P5 (SEQ ID NO:633), and a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERADGSS-LPEWVTDNAGTLHFARVTRDDAGNYTCIASNGPQGQ IRAHVQLT VAVFITFKVEPERT-TVYQGHTALLQCEAQGDPKPLI-QWKGKDRILDPTKLGPRMHIFQNG SLVIHDVAPEDS-GRYTCIAGNSCNIKHTEAPLYVVDKPVPEESEGPGSPP PYKMIQTIGLSV GAAVAYIIAVLGLMFYCKKRCK-AKRLQKQPEGEEPEMECLNGEGPWTGR-WCPCAGAER PPAATEGRAPALWKPSGCCWVLELGL-PHP (SEQ ID NO:634) corresponding to amino acids 410-796 of T51958_P5 (SEQ ID NO:633), wherein said first amino acid sequence and second amino acid sequence are contiguous and in a sequential order.

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERADGSS-LPEWVTDNAGTLHFARVTRDDAGNYTCIASNGPQGQ IRAHVQLT VAVFITFKVEPERT-TVYQGHTALLQCEAQGDPKPLI-QWKGKDRILDPTKLGPRMHIFQNG SLVIHDVAPEDS-GRYTCIAGNSCNIKHTEAPLYVVDKPVPEESEGPGSPP PYKMIQTIGLSV GAAVAYIIAVLGLMFYCKKRCK-AKRLQKQPEGEEPEMECLNGEGPWTGR-WCPCAGAER PPAATEGRAPALWKPSGCCWVLELGL-PHP of T51958_P5 (SEQ ID NO:633).

An isolated chimeric polypeptide encoding for T51958_P5 (SEQ ID NO:633), comprising a first amino acid sequence being at least 70%, optionally at least 80%, preferably at least 85%, more preferably at least 90% and most preferably at least 95%, homologous to a polypeptide having the sequence MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVATVPSWLKKPQD S QLEEGKPGYLDCLTQATPKPTVVWYRN-QMLISEDSRFEVFKNGTLRINSVEVYDGTWYR CMSSTPAGSIEAQARVQVLEKLKFTPP-PQPQQCMEFDKEATVPCSATGREKPTIKWERAD GSS-LPEWVTDNAGTLHFARVTRDDAGNYT-CIASNGPQGQIRAHVQLTVAVFITFKVEPER TTVYQGHTALLQCEAQGDPKPLI-QWKGKDRILDPTKLGPRMHIFQNGSLVIHDVAPEDSG RYTCIAGNSCNIKHTEAPLYVV (SEQ ID NO:639) corresponding to amino acids 1-682 of T51958_P5 (SEQ ID NO:633), a second amino acid sequence being at least 90% homologous to amino acids 28-96 of Q6ZMU3_HUMAN, which also corresponds to amino acids 683-751 of T51958_P5 (SEQ ID NO:633), and a third amino acid sequence being at least 70%, optionally at least 80%, preferably at least 85%, more preferably at least 90% and most preferably at least 95% homologous to a polypeptide having the sequence EGPWTGRWCPCAGAERPPAATEGRA-PALWKPSGCCWVLELGLPHP (SEQ ID NO:634) corresponding to amino acids 752-796 of T51958_P5 (SEQ ID NO:633), wherein said first amino acid sequence, second amino acid sequence and third amino acid sequence are contiguous and in a sequential order.

An isolated polypeptide encoding for a head of T51958 P5 (SEQ ID NO:633), comprising a polypeptide being at least 70%, optionally at least about 80%, preferably at least about 85%, more preferably at least about 90% and most preferably at least about 95% homologous to the sequence MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVATVPSWLKKPQD S QLEEGKPGYLDCLTQATPKPTVVWYRN-QMLISEDSRFEVFKNGTLRINSVEVYDGTWYR CMSSTPAGSIEAQARVQVLEKLKFTPP-PQPQQCMEFDKEATVPCSATGREKPTIKWERAD GSS-LPEWVTDNAGTLHFARVTRDDAGNYT-CIASNGPQGQIRAHVQLTVAVFITFKVEPER TTVYQGHTALLQCEAQGDPKPLI-QWKGKDRILDPTKLGPRMHIFQNGSLVIHDVAPEDSG RYTCIAGNSCNIKHTEAPLYVV (SEQ ID NO:639) of T51958_P5 (SEQ ID NO:633).

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

An isolated chimeric polypeptide encoding for T51958_P5 (SEQ ID NO:633), comprising a first amino acid sequence being at least 70%, optionally at least 80%, preferably at least 85%, more preferably at least 90% and most preferably at least 95%, homologous to a polypeptide having the sequence MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPSVWW corresponding to amino acids 1-356 of T51958_P5 (SEQ ID NO:633), a second amino acid sequence being at least 90% homologous to amino acids 1-105 of Q9NSQ6_HUMAN, which also corresponds to amino acids 357-461 of T51958_P5 (SEQ ID NO:633), and a third amino acid sequence being at least 70%, optionally at least 80%, preferably at least 85%, more preferably at least 90% and most preferably at least 95% homologous to a polypeptide having the sequence KNGTLRINSVEVYDGTWYRCMSSTPAG-SIEAQARVQVLEKLKFTPPPQPQQCMEFDKEAT VPC-SATGREKPTIKWERADGSSLPEWVTD-NAGTLHFARVTRDDAGNYTCIASNGPQGQIR AHVQLTVAVFITFKVEPERT-TVYQGHTALLQCEAQGDPKPLI-QWKGKDRILDPTKLGPRM HIFQNGSLVIHDVAPEDS-GRYTCIAGNSCNIKHTEAPLYVVDKPVPEESEGPGSPP PYKMIQ TIGLSVGAAVAYIIAVLGLMFYCKKRCK-AKRLQKQPEGEEPEMECLNGEGPWTGRWCPC AGAERPPAATEGRAPALWKPSGCCWVLELGLPHP (SEQ ID NO:640) corresponding to amino acids 462-796 of T51958_P5 (SEQ ID NO:633), wherein said first amino acid sequence, second amino acid sequence and third amino acid sequence are contiguous and in a sequential order.

An isolated polypeptide encoding for a head of T51958_P5 (SEQ ID NO:633), comprising a polypeptide being at least 70%, optionally at least about 80%, preferably at least about 85%, more preferably at least about 90% and most preferably at least about 95% homologous to the sequence MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPSVWW of T51958_P5 (SEQ ID NO:633).

An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence KNGTLRINSVEVYDGTWYRCMSSTPAG-SIEAQARVQVLEKLKFTPPPQPQQCMEFDKEAT VPC-SATGREKPTIKWERADGSSLPEWVTD-NAGTLHFARVTRDDAGNYTCIASNGPQGQIR AHVQLTVAVFITFKVEPERT-TVYQGHTALLQCEAQGDPKPLI-QWKGKDRILDPTKLGPRM HIFQNGSLVIHDVAPEDS-GRYTCIAGNSCNIKHTEAPLYVVDKPVPEESEGPGSPP PYKMIQ TIGLSVGAAVAYIIAVLGLMFYCKKRCK-AKRLQKQPEGEEPEMECLNGEGPWTGRWCPC AGAERPPAATEGRAPALWKPSGCCWVLELGLPHP (SEQ ID NO:640) of T51958_P5 (SEQ ID NO:633).

The isolated oligonucleotide as described above, comprising an T27396 amplicon having a sequence as set forth in any one of the T27396 jun43-45 (SEQ ID NO:502), or T27396 jun60-65 (SEQ ID NO:505).

The isolated oligonucleotide as described above, comprising an HSI6REC amplicon having a sequence as set forth in HSI6RECjunc10-16-18 (SEQ ID NO:468).

The isolated oligonucleotide as described above, comprising an HSU40434 amplicon having a sequence as set forth in HSU40434 seg37-38 (SEQ ID NO:471).

The isolated oligonucleotide as described above, comprising an M62246 amplicon having a sequence as set forth in M62246 seg18.

The isolated oligonucleotide as described above, comprising an M78076 amplicon having a sequence as set forth in any one of the M78076Junc 36-45-47, M78076seg32, M78076seg46.

The isolated oligonucleotide as described above, comprising an HSUPARAA amplicon having a sequence as set forth in any one of the HSUPARAA_seg22WT (SEQ ID NO:487), HSUPARAA_seg28-32 (SEQ ID NO:490), HSUPARAA seg19-22 (SEQ ID NO:493).

The isolated oligonucleotide as described above, comprising an R11723 amplicon having a sequence as set forth in any one of the R11723 junc11-18 (SEQ ID NO:496) (SEQ ID NO:496), R11723seg13 (SEQ ID NO:499).

The isolated oligonucleotide as described above, comprising an T51958 amplicon having a sequence as set forth in any one of the T51958 junc21-33 (SEQ ID NO:508), T51958seg38 (SEQ ID NO:511), T51958seg7 (SEQ ID NO:514).

A primer pair, comprising a pair of isolated oligonucleotides capable of amplifying one of said amplicons.

The primer pair as described above, comprising a pair of isolated oligonucleotides capable of amplifying one of said T27396 amplicons, selected from the group comprising: T27396 junc43-45F (SEQ ID NO:500) and T27396 junc43-45R (SEQ ID NO:501) or T27396 jun60-65F (SEQ ID NO:503) and T27396 jun60-65R (SEQ ID NO:504).

The primer pair as described above, comprising a pair of isolated oligonucleotides capable of amplifying one of said HSI6REC amplicons, having a sequence as set forth in: HSI6REC junc10-16-18F (SEQ ID NO:466) and HSI6REC junc10-16-18R (SEQ ID NO:467).

The primer pair as described above, comprising a pair of isolated oligonucleotides capable of amplifying one of said HSU40434 amplicons, having a sequence as set forth in: HSU40434 seg37-38F (SEQ ID NO:469) and HSU40434 seg37-38R (SEQ ID NO:470)

The oligonucleotide probe as described above, comprising an isolated nucleic acid sequence capable of detecting one of said M62246 amplicons, having a sequence as set fort in: M62246_0_0_21175 (SEQ ID NO:472)

The primer pair as described above, comprising a pair of isolated oligonucleotides capable of amplifying one of said M78076 amplicons, having a sequence selected from the group comprising: M78076Junc 36-45-47F (SEQ ID NO:473) and M78076Junc 36-45-47R (SEQ ID NO:474), M78076seg32F2 (SEQ ID NO:476) and M78076seg32R2 (SEQ ID NO:477), M78076seg46F (SEQ ID NO:479) and M78076seg46R (SEQ ID NO:480).

The primer pair as described above, comprising a pair of isolated oligonucleotides capable of amplifying one of said HSUPARAA amplicons, having a sequence selected from the group comprising: HSUPARAA seg22F (SEQ ID NO:482) and HSUPARAA seg22R (SEQ ID NO:483), HSUPARAA seg28-32F (SEQ ID NO:488) and HSUPARAA seg28-32R (SEQ ID NO:489), HSUPARAA seg19-22F (SEQ ID NO:491) and HSUPARAA seg19-22R (SEQ ID NO:492).

The primer pair as described above, comprising a pair of isolated oligonucleotides capable of amplifying one of said R11723 amplicons, having a sequence selected from the group comprising: R11723junc11-18F (SEQ ID NO:494) and R11723junc11-18R (SEQ ID NO:495), R11723seg13F (SEQ ID NO:497) and R11723seg13R (SEQ ID NO:498).

The primer pair as described above, comprising a pair of isolated oligonucleotides capable of amplifying one of said T51958 amplicons, selected from the group comprising: T51958 junc21-33F (SEQ ID NO:506) and T51958 junc21-33R (SEQ ID NO:507), T51958seg38F (SEQ ID NO:509) and T51958seg38R (SEQ ID NO:510), T51958seg7F (SEQ ID NO:512) and T51958 seg7R (SEQ ID NO:513).

An antibody capable of specifically binding to an epitope of an amino acid sequence as described herein.

An antibody capable of specifically binding to an epitope of an amino acid sequence as described above, optionally wherein said amino acid sequence corresponds to a bridge, edge portion, tail, or head as in any of the previous claims, also optionally wherein said antibody is capable of differentiating between a splice variant having said epitope and a corresponding known protein.

A kit for detecting a Marker-detectable disease, comprising a kit detecting specific expression of a splice variant as described herein.

Optionally, the kit comprises a NAT-based technology; optionally and preferably, the kit further comprises at least one nucleotide probe or primer, alternatively and optionally this kit comprises at least one primer pair capable of selectively hybridizing to a nucleic acid sequence as described herein; alternatively and optionally, said kit further comprises at least one oligonucleotide capable of selectively hybridizing to a nucleic acid sequence according to any of the above claims.

Alternatively and optionally, the kit comprises an antibody according to any of the above claims (optionally and preferably, the kit further comprises at least one reagent for performing an ELISA or a Western blot.

A method for detecting a Marker-detectable disease, comprising detecting specific expression of a splice variant as described herein; optionally the marker-detectable disease is cluster T27396 marker-detectable disease and is selected from the group consisting of variety of cancers, including but not limited to epithelial malignant tumors, ovarian cancer, ovarian cancer invasion and metastasis, breast cancer and breast cancer invasion and metastasis Alternatively and optionally, the marker-detectable disease is cluster HSI6REC marker-detectable disease and is selected from the group consisting of variety of cancers, including but not limited to colon cancer and lung cancer.

Alternatively and optionally, the marker-detectable disease is cluster HSU40434 marker-detectable disease and is selected from the group consisting of variety of cancers and malignant tumors from different tissues, including but not limited to pancreas carcinoma, ovarian cancer, lung cancer and epithelial malignant tumors.

Alternatively and optionally, the marker-detectable disease is cluster M62246 marker-detectable disease and is selected from the group consisting of variety of cancers, including but not limited to epithelial malignant tumors and lung cancer.

Alternatively and optionally, the marker-detectable disease is cluster M78076 marker-detectable disease and is selected from the group consisting of variety of cancers, including but not limited to lung cancer. Alternatively and optionally, cluster M78076 marker-detectable disease is selected from the group consisting of various disorders related to brain damage, including but not limited to injury to the brain that is caused by various conditions, such as head trauma, inadequate oxygen supply, infection, or stroke, such as ischemic stroke, hemorrhagic stroke, embolic infarct, thrombotic infarct, lacunar infarct, transient ischemic attack, intracranial hemorrhages, epidural hematoma subdural hematoma, subarachnoid hemorrhage, intracerebral hemorrhage, degenerative brain diseases or conditions (including but not limited to Alzheimer's disease, Parkinson's disease, cerebellar degeneration, spinocerebellar degeneration, corticobasal degeneration, Alpers' disease, Olivopontocerebellar atrophy (OPCA) and HTLV-1 associated myelopathy/tropical spastic paraparesis (HAM/TSP)), or any other disease in which neuronal injury is part of the disease process.

Alternatively and optionally, the marker-detectable disease is cluster HSUPARAA marker-detectable disease and is selected from the group consisting of variety of cancers, including but not limited to lung cancer, squamous cell lung cancer, prostate cancer, breast cancer, ovarian cancer, endometrial cancer, cervical cancer, rectal cancer, acute myeloid leukemia (AML), metastasis and invasion of neuroblastoma. Alternatively and optionally, HSUPARAA marker-detectable disease is selected from the group consisting of Paroxysmal nocturnal hemoglobinuria (PNH), predictor of survival in human immunodeficiency virus infection and Streptococcus pneumoniae bacteraemia.

Alternatively and optionally, the marker-detectable disease is cluster R11723 marker-detectable disease and is selected from the group consisting of variety of cancers, including but not limited to epithelial malignant tumors, lung cancer, ovarian cancer, breast cancer, colon cancer, and prostate cancer.

Alternatively and optionally, the marker-detectable disease is cluster T51958 marker-detectable disease and is selected from the group consisting of variety of cancers, including but not limited to epithelial malignant tumors, colon cancer, colorectal cancer and brain malignant tumors.

Detecting specific expression is optionally performed with a NAT-based technology (optionally comprising at least one nucleotide probe or primer), and/or with an immunoassay (optionally comprising an antibody according to any of the above embodiments).

There is also optionally provided a biomarker capable of detecting Marker-detectable disease, comprising any of the above nucleic acid sequences or a fragment thereof, or any of the above amino acid sequences or a fragment thereof.

There is also optionally provided a method for screening for variant-detectable disease, comprising detecting cells affected by a Marker-detectable disease with a biomarker or an antibody or a method or assay according to any of the above embodiments.

There is also optionally provided a method for screening for a disease, comprising detecting cells affected by the disease using a marker selected from the group consisting of:

a. an amino acid sequence selected from the group consisting of SEQ ID NOs:24-28, 80-84, 111-114, 169-177, 226-237, 276-281, 339-349, 423-429, 633, 641-642 or a homologue or fragment thereof;

b. an amino acid sequence corresponding to a bridge, edge portion, tail, or head having an amino acid sequence selected from the group consisting of SEQ ID NOs:518-589, 596-599, 601-630, 633-644 or a homologue or fragment thereof;

c. a polynucleotide having a sequence selected from the group consisting of SEQ ID NOs:1-6, 29-33, 85-92, 115-125, 178-192, 238-246, 282-293, 350-361, 631-632 or a homologue or fragment thereof;

d. a polynucleotide comprising a node having a sequence selected from the group consisting of SEQ ID NOs:7-19, 34-70, 93-107, 126-165, 193-215, 247-269, 294-337, 362-408;

e. an antibody capable of specifically binding to at least one epitope of an amino acid sequence selected from the group consisting of SEQ ID NOs:24-28, 80-84, 111-114, 169-177, 226-237, 276-281, 339-349, 423-429, 518-589, 596-599, 601-630, 633-644;

f. an oligonucleotide comprising an amplicon having a sequence selected from the group consisting of SEQ ID NOs: 468, 471, 475, 478, 481, 484, 487, 490, 493, 496, 499, 502, 505, 508, 511, 514;

g. a primer pair, comprising a pair of isolated oligonucleotides capable of amplifying an amplicon having a sequence selected from the group consisting of SEQ ID NOs:468, 471, 475, 478, 481, 484, 487, 490, 493, 496, 499, 502, 505, 508, 511, 514; to detect differential expression of a splice variant according to the invention.

There is also optionally provided a method for diagnosing a marker-detectable disease, comprising detecting cells affected by Marker-detectable disease with a biomarker or an antibody or a method or assay according to any of the above embodiments.

There is also optionally provided a method for diagnosing a disease, comprising detecting cells affected by the disease using a marker selected from the group consisting of:

a. an amino acid sequence selected from the group consisting of SEQ ID NOs:24-28, 80-84, 111-114, 169-177, 226-237, 276-281, 339-349, 423-429, 633, 641-642 or a homologue or fragment thereof;

b. an amino acid sequence corresponding to a bridge, edge portion, tail, or head having an amino acid sequence selected from the group consisting of SEQ ID NOs:518-589, 596-599, 601-630, 633-644 or a homologue or fragment thereof;

c. a polynucleotide having a sequence selected from the group consisting of SEQ ID NOs:1-6, 29-33, 85-92, 115-125, 178-192, 238-246, 282-293, 350-361, 631-632 or a homologue or fragment thereof;

d. a polynucleotide comprising a node having a sequence selected from the group consisting of SEQ ID NOs:7-19, 34-70, 93-107, 126-165, 193-215, 247-269, 294-337, 362-408;

e. an antibody capable of specifically binding to at least one epitope of an amino acid sequence selected from the group consisting of SEQ ID NOs:24-28, 80-84, 111-114, 169-177, 226-237, 276-281, 339-349, 423-429, 518-589, 596-599, 601-630, 633-644;

f. an oligonucleotide comprising an amplicon having a sequence selected from the group consisting of SEQ ID NOs: 468, 471, 475, 478, 481, 484, 487, 490, 493, 496, 499, 502, 505, 508, 511, 514;

g. a primer pair, comprising a pair of isolated oligonucleotides capable of amplifying an amplicon having a sequence selected from the group consisting of SEQ ID NOs:468, 471, 475, 478, 481, 484, 487, 490, 493, 496, 499, 502, 505, 508, 511, 514, to detect differential expression of a splice variant according to the invention.

There is also optionally provided a method for monitoring disease progression and/or treatment efficacy and/or relapse of Marker-detectable disease, comprising detecting cells affected by Marker-detectable disease with a biomarker or an antibody or a method or assay according to any of the above embodiments.

There is also optionally provided a method for monitoring disease progression or treatment efficacy or relapse of a disease, comprising detecting cells affected by the disease using a marker selected from the group consisting of:

a. an amino acid sequence selected from the group consisting of SEQ ID NOs:24-28, 80-84, 111-114, 169-177, 226-237, 276-281, 339-349, 423-429, 633, 641-642 or a homologue or fragment thereof;

b. an amino acid sequence corresponding to a bridge, edge portion, tail, or head having an amino acid sequence selected from the group consisting of SEQ ID NOs:518-589, 596-599, 601-630, 633-644 or a homologue or fragment thereof;

c. a polynucleotide having a sequence selected from the group consisting of SEQ ID NOs:1-6, 29-33, 85-92, 115-125, 178-192, 238-246, 282-293, 350-361, 631-632 or a homologue or fragment thereof;

d. a polynucleotide comprising a node having a sequence selected from the group consisting of SEQ ID NOs:7-19, 34-70, 93-107, 126-165, 193-215, 247-269, 294-337, 362-408;

e. an antibody capable of specifically binding to at least one epitope of an amino acid sequence selected from the group consisting of SEQ ID NOs:24-28, 80-84, 111-114, 169-177, 226-237, 276-281, 339-349, 423-429, 518-589, 596-599, 601-630, 633-644;

f. an oligonucleotide comprising an amplicon having a sequence selected from the group consisting of SEQ ID NOs: 468, 471, 475, 478, 481, 484, 487, 490, 493, 496, 499, 502, 505, 508, 511, 514;

g. a primer pair, comprising a pair of isolated oligonucleotides capable of amplifying an amplicon having a sequence selected from the group consisting of SEQ ID NOs:468, 471, 475, 478, 481, 484, 487, 490, 493, 496, 499, 502, 505, 508, 511, 514, to detect differential expression of a splice variant according to the invention.

There is also optionally provided a method of selecting a therapy for a marker-detectable disease, comprising detecting cells affected by a marker-detectable disease with a biomarker or an antibody or a method or assay according to any of the above embodiments and selecting a therapy according to said detection.

There is also optionally provided a method of selecting a therapy for a disease, comprising detecting cells affected by the disease using a marker selected from the group consisting of:

a. an amino acid sequence selected from the group consisting of SEQ ID NOs:24-28, 80-84, 111-114, 169-177, 226-237, 276-281, 339-349, 423-429, 633, 641-642 or a homologue or fragment thereof;

b. an amino acid sequence corresponding to a bridge, edge portion, tail, or head having an amino acid sequence selected from the group consisting of SEQ ID NOs:518-589, 596-599, 601-630, 633-644 or a homologue or fragment thereof;

c. a polynucleotide having a sequence selected from the group consisting of SEQ ID NOs:1-6, 29-33, 85-92, 115-125, 178-192, 238-246, 282-293, 350-361, 631-632 or a homologue or fragment thereof;

d. a polynucleotide comprising a node having a sequence selected from the group consisting of SEQ ID NOs:7-19, 34-70, 93-107, 126-165, 193-215, 247-269, 294-337, 362-408;

e. an antibody capable of specifically binding to at least one epitope of an amino acid sequence selected from the group consisting of SEQ ID NOs:24-28, 80-84, 111-114, 169-177, 226-237, 276-281, 339-349, 423-429, 518-589, 596-599, 601-630, 633-644;

f. an oligonucleotide comprising an amplicon having a sequence selected from the group consisting of SEQ ID NOs: 468, 471, 475, 478, 481, 484, 487, 490, 493, 496, 499, 502, 505, 508, 511, 514;

g. a primer pair, comprising a pair of isolated oligonucleotides capable of amplifying an amplicon having a sequence selected from the group consisting of SEQ ID NOs:468, 471, 475, 478, 481, 484, 487, 490, 493, 496, 499, 502, 505, 508, 511, 514, to detect differential expression of a splice variant according to the invention and selecting a therapy according to said detection.

The method of any of the above claims may optionally be used when the marker-detectable disease is cluster T27396 marker-detectable disease and is selected from the group consisting of cluster T27396 marker-detectable disease and is selected from the group consisting of variety of cancers, including but not limited to epithelial malignant tumors, ovarian cancer, ovarian cancer invasion and metastasis, breast cancer and breast cancer invasion and metastasis.

Alternatively and optionally, such a method may be used when the marker-detectable disease is cluster HSI6REC marker-detectable disease and is selected from the group consisting of variety of cancers, including but not limited to colon cancer and lung cancer.

Alternatively and optionally, such a method may be used when the marker-detectable disease is cluster HSU40434 marker-detectable disease and is selected from the group consisting of variety of cancers and malignant tumors from different tissues, including but not limited to pancreas carcinoma, ovarian cancer, lung cancer and epithelial malignant tumors.

Alternatively and optionally, such a method may be used when the marker-detectable disease is cluster M62246 marker-detectable disease and is selected from the group consisting of variety of cancers, including but not limited to epithelial malignant tumors and lung cancer.

Alternatively and optionally, such a method may optionally be used when the marker-detectable disease is cluster M78076 marker-detectable disease and is selected from the group consisting of variety of cancers, including but not limited to lung cancer. Alternatively and optionally, cluster M78076 marker-detectable disease is selected from the group consisting of various disorders related to brain damage, including but not limited to injury to the brain that is caused by various conditions, such as head trauma, inadequate oxygen supply, infection, or stroke, such as ischemic stroke, hemorrhagic stroke, embolic infarct, thrombotic infarct, lacunar infarct, transient ischemic attack, intracranial hemorrhages, epidural hematoma subdural hematoma, subarachnoid hemorrhage, and intracerebral hemorrhage, degenerative brain diseases or conditions (including but not limited to Alzheimer's disease, Parkinson's disease, cerebellar degeneration, spinocerebellar degeneration, corticobasal degeneration, Alpers' disease, Olivopontocerebellar atrophy (OPCA) and HTLV-1 associated myelopathy/ tropical spastic paraparesis (HAM/TSP)), or any other disease in which neuronal injury is part of the disease process.

Alternatively and optionally, such a method may optionally be used when the marker-detectable disease is cluster HSUPARAA marker-detectable disease and is selected from the group consisting of variety of cancers, including but not limited to lung cancer, squamous cell lung cancer, prostate cancer, breast cancer, ovarian cancer, endometrial cancer, cervical cancer, rectal cancer, acute myeloid leukemia (AML), metastasis and invasion of neuroblastoma. Alternatively and optionally, HSUPARAA marker-detectable disease is selected from the group consisting of Paroxysmal nocturnal hemoglobinuria (PNH), predictor of survival in human immunodeficiency virus infection and *Streptococcus pneumoniae bacteraemia*.

Alternatively and optionally, such a method may be used when the marker-detectable disease is cluster R11723 marker-detectable disease and is selected from the group consisting of variety of cancers, including but not limited to epithelial malignant tumors, lung cancer, ovarian cancer, breast cancer, colon cancer, and prostate cancer.

Alternatively and optionally, such a method may be used when the marker-detectable disease is cluster T51958 marker-detectable disease and is selected from the group consisting of variety of cancers, including but not limited to epithelial malignant tumors, colon cancer, colorectal cancer and brain malignant tumors.

According to preferred embodiments of the present invention, preferably any of the above nucleic acid and/or amino acid sequences further comprises any sequence having at least about 70%, preferably at least about 80%, more preferably at least about 90%, most preferably at least about 95% homology thereto.

Unless otherwise noted, all experimental data relates to variants of the present invention, named according to the segment being tested (as expression was tested through RT-PCR as described).

All nucleic acid sequences and/or amino acid sequences shown herein as embodiments of the present invention relate to their isolated form, as isolated polynucleotides (including for all transcripts), oligonucleotides (including for all segments, amplicons and primers), peptides (including for all tails, bridges, insertions or heads, optionally including other antibody epitopes as described herein) and/or polypeptides (including for all proteins). It should be noted that oligonucleotide and polynucleotide, or peptide and polypeptide, may optionally be used interchangeably.

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). All of these are hereby incorporated by reference as if fully set forth herein. As used herein, the following terms have the meanings ascribed to them unless specified otherwise.

BRIEF DESCRIPTION OF DRAWINGS

FIG. 15B is a histogram showing expression of *Homo sapiens* amyloid beta (A4) precursor-like protein 1 (APLP1) M78076 transcripts which are detectable by amplicon as depicted in sequence name M78076 seg32 in different normal tissues

DESCRIPTION OF PREFERRED EMBODIMENTS

Figure 1:
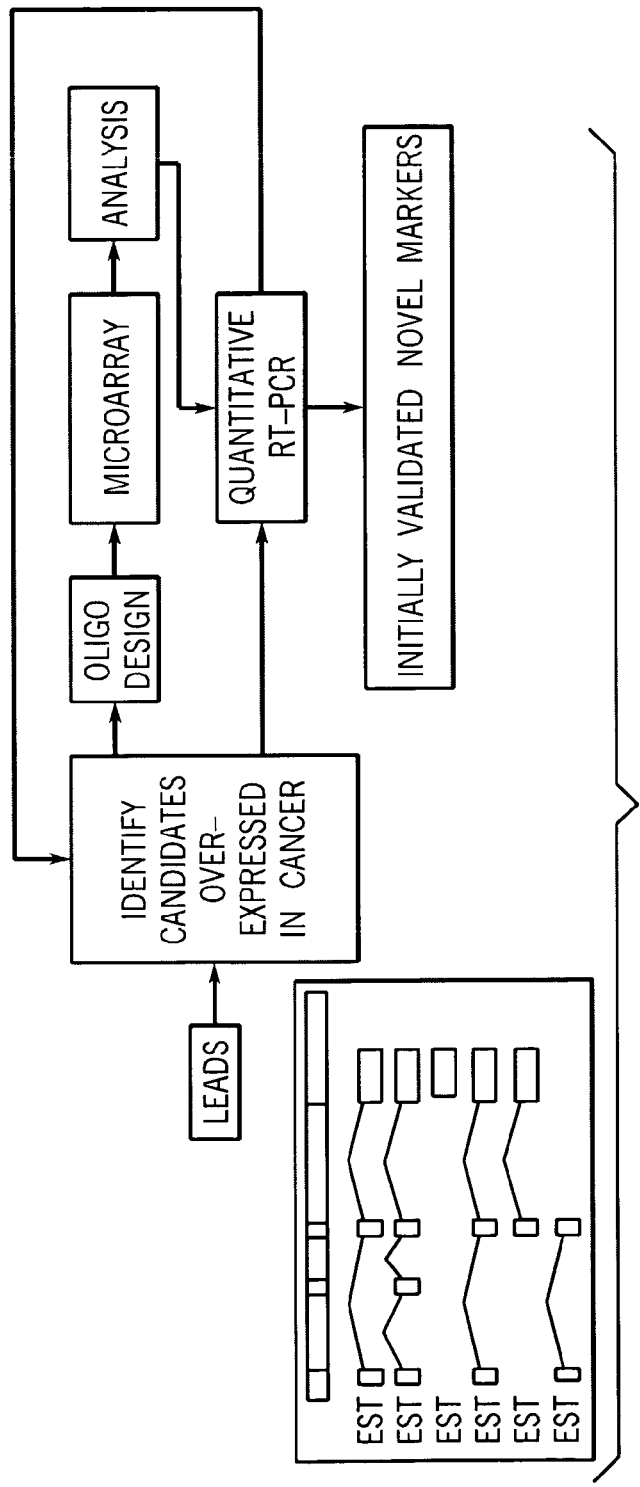
FIG. 1 shows schematic summary of the cancer biomarkers selection engine and the following wet validation stages.

The present invention provides variants, which may optionally be used as diagnostic markers.

Preferably these variants are useful as diagnostic markers for marker-detectable (also referred to herein as "variant-detectable") diseases as described herein.

Differential variant markers are collectively described as "variant disease markers".

The markers of the present invention, alone or in combination, can be used for prognosis, prediction, screening, early diagnosis, staging, therapy selection and treatment monitoring of a marker-detectable disease. For example, optionally and preferably, these markers may be used for staging the disease in patient (for example if the disease features cancer)

and/or monitoring the progression of the disease. Furthermore, the markers of the present invention, alone or in combination, can be used for detection of the source of metastasis found in anatomical places other than the originating tissue, again in the example of cancer. Also, one or more of the markers may optionally be used in combination with one or more other disease markers (other than those described herein).

Biomolecular sequences (amino acid and/or nucleic acid sequences) uncovered using the methodology of the present invention and described herein can be efficiently utilized as tissue or pathological markers and/or as drugs or drug targets for treating or preventing a disease.

These markers are specifically released to the bloodstream under conditions of a particular disease, and/or are otherwise expressed at a much higher level and/or specifically expressed in tissue or cells afflicted with or demonstrating the disease. The measurement of these markers, alone or in combination, in patient samples provides information that the diagnostician can correlate with a probable diagnosis of a particular disease and/or a condition that is indicative of a higher risk for a particular disease.

The present invention therefore also relates to diagnostic assays for marker-detectable disease and/or an indicative condition, and methods of use of such markers for detection of marker-detectable disease and/or an indicative condition, optionally and preferably in a sample taken from a subject (patient), which is more preferably some type of blood sample.

Information given in the text with regard to cellular localization was determined according to four different software programs: (i) tmhmm (from Center for Biological Sequence Analysis, Technical University of Denmark DTU, http://www.cbs.dtu.dk/services/TMHMM/TMHMM2.0b.guide.php) or (ii) tmpred (from EMBnet, maintained by the ISREC Bionformatics group and the LICR Information Technology Office, Ludwig Institute for Cancer Research, Swiss Institute of Bioinformatics, http://www.ch.embnet.org/software/TM-PRED_form.html) for transmembrane region prediction; (iii) signalp_hmm or (iv) signalp_nn (both from Center for Biological Sequence Analysis, Technical University of Denmark DTU, http://www.cbs.dtu.dk/services/SignalP/background/prediction.php) for signal peptide prediction. The terms "signalp_hmm" and "signalp_nn" refer to two modes of operation for the program SignalP: hmm refers to Hidden Markov Model, while nn refers to neural networks. Localization was also determined through manual inspection of known protein localization and/or gene structure, and the use of heuristics by the individual inventor. In some cases for the manual inspection of cellular localization prediction inventors used the Pro-Loc computational platform [Einat Hazkani-Covo, Erez Levanon, Galit Rotman, Dan Graur and Amit Novik; (2004) "Evolution of multicellularity in metazoa: comparative analysis of the subcellular localization of proteins in *Saccharomyces, Drosophila* and *Caenorhabditis*." Cell Biology International 2004;28(3):171-8.], which predicts protein localization based on various parameters including, protein domains (e.g., prediction of trans-membranous regions and localization thereof within the protein), pI, protein length, amino acid composition, homology to pre-annotated proteins, recognition of sequence patterns which direct the protein to a certain organelle (such as, nuclear localization signal, NLS, mitochondria localization signal), signal peptide and anchor modeling and using unique domains from Pfam that are specific to a single compartment.

Information is given in the text with regard to SNPs (single nucleotide polymorphisms). A description of the abbreviations is as follows. "T->C", for example, means that the SNP results in a change at the position given in the table from T to C. Similarly, "M->Q", for example, means that the SNP has caused a change in the corresponding amino acid sequence, from methionine (M) to glutamine (Q). If, in place of a letter at the right hand side for the nucleotide sequence SNP, there is a space, it indicates that a frameshift has occurred. A frameshift may also be indicated with a hyphen (-). A stop codon is indicated with an asterisk at the right hand side (*). As part of the description of an SNP, a comment may be found in parentheses after the above description of the SNP itself. This comment may include an FTId, which is an identifier to a SwissProt entry that was created with the indicated SNP. An FTId is a unique and stable feature identifier, which allows construction of links directly from position-specific annotation in the feature table to specialized protein-related databases. The FTId is always the last component of a feature in the description field, as follows: FTId=XXX_number, in which XXX is the 3-letter code for the specific feature key, separated by an underscore from a 6-digit number. In the table of the amino acid mutations of the wild type proteins of the selected splice variants of the invention, the header of the first column is "SNP position(s) on amino acid sequence", representing a position of a known mutation on amino acid sequence. SNPs may optionally be used as diagnostic markers according to the present invention, alone or in combination with one or more other SNPs and/or any other diagnostic marker. Preferred embodiments of the present invention comprise such SNPs, including but not limited to novel SNPs on the known (WT or wild type) protein sequences given below, as well as novel nucleic acid and/or amino acid sequences formed through such SNPs, and/or any SNP on a variant amino acid and/or nucleic acid sequence described herein.

Information given in the text with regard to the Homology to the known proteins was determined by Smith-Waterman version 5.1.2 using special (non default) parameters as follows:
model=sw.model
GAPEXT=0
GAPOP=100.0
MATRIX=blosum100

Information is given with regard to overexpression of a cluster in cancer based on ESTs. A key to the p values with regard to the analysis of such overexpression is as follows:
library-based statistics: P-value without including the level of expression in cell-lines (P1)
library based statistics: P-value including the level of expression in cell-lines (P2)
EST clone statistics: P-value without including the level of expression in cell-lines (SP1)
EST clone statistics: predicted overexpression ratio without including the level of expression in cell-lines (R3)
EST clone statistics: P-value including the level of expression in cell-lines (SP2)
EST clone statistics: predicted overexpression ratio including the level of expression in cell-lines (R4)

Library-based statistics refer to statistics over an entire library, while EST clone statistics refer to expression only for ESTs from a particular tissue or cancer.

Information is given with regard to overexpression of a cluster in cancer based on microarrays. As a microarray reference, in the specific segment paragraphs, the unabbreviated tissue name was used as the reference to the type of chip for which expression was measured. There are two types of microarray results: those from microarrays prepared according to a design by the present inventors, for which the microarray fabrication procedure is described in detail in Materials and Experimental Procedures section herein; and those results from microarrays using Affymetrix technology. As a microarray reference, in the specific segment paragraphs, the unabbreviated tissue name was used as the reference to the type of chip for which expression was measured. For microarrays prepared according to a design by the present inventors, the probe name begins with the name of the cluster (gene), followed by an identifying number. Oligonucleotide microarray results taken from Affymetrix data were from chips available from Affymetrix Inc, Santa Clara, Calif., USA (see for example data regarding the Human Genome U133 (HG-U133) Set at.affymetrix.com/products/arrays/specific/ hgu133.affx; GeneChip Human Genome U133A 2.0 Array at.affymetrix. com/products/arrays/specific/hgu133.affx).; and Human Genome U133 Plus 2.0 Array at /hgu133plus.affx). The probe names follow the Affymetrix naming convention. The data is available from NCBI Gene Expression Omnibus (see .ncbi.nlm.nih.gov/projects/geo/ and Edgar et al, Nucleic Acids Research, 2002, Vol. 30, No. 1 207-210). The dataset (including results) is available from .ncbi.nlm.nih.gov/geo/query/acc.cgi?acc=GSE1133 for the Series GSE1133 database (published on Mar. 2004); a reference to these results is as follows: Su et al (Proc Natl Acad Sci USA. Apr. 20, 2004;101(16):6062-7. Epub Apr. 09).

It should be noted that the terms "segment", "seg" and "node" are used interchangeably in reference to nucleic acid sequences of the present invention, they refer to portions of nucleic acid sequences that were shown to have one or more properties as described below. They are also the building blocks that were used to construct complete nucleic acid sequences as described in greater detail below. Optionally and preferably, they are examples of oligonucleotides which are embodiments of the present invention, for example as amplicons, hybridization units and/or from which primers and/or complementary oligonucleotides may optionally be derived, and/or for any other use.

As used herein the phrase "disease" includes any type of pathology and/or damage, including both chronic and acute damage, as well as a progress from acute to chronic damage.

The term "marker" in the context of the present invention refers to a nucleic acid fragment, a peptide, or a polypeptide, which is differentially present in a sample taken from patients (subjects) having one of the herein-described diseases or conditions, as compared to a comparable sample taken from subjects who do not have one the above-described diseases or conditions.

The phrase "differentially present" refers to differences in the quantity of a marker present in a sample taken from patients having one of the herein-described diseases or conditions as compared to a comparable sample taken from patients who do not have one of the herein-described diseases or conditions. For example, a nucleic acid fragment may optionally be differentially present between the two samples if the amount of the nucleic acid fragment in one sample is significantly different from the amount of the nucleic acid fragment in the other sample, for example as measured by hybridization and/or NAT-based assays. A polypeptide is differentially present between the two samples if the amount of the polypeptide in one sample is significantly different from the amount of the polypeptide in the other sample. It should be noted that if the marker is detectable in one sample and not detectable in the other, then such a marker can be considered to be differentially present. Optionally, a relatively low amount of up-regulation may serve as the marker, as described herein. One of ordinary skill in the art could easily determine such relative levels of the markers; further guidance is provided in the description of each individual marker below.

As used herein the phrase "diagnostic" means identifying the presence or nature of a pathologic condition. Diagnostic methods differ in their sensitivity and specificity. The "sensitivity" of a diagnostic assay is the percentage of diseased individuals who test positive (percent of "true positives"). Diseased individuals not detected by the assay are "false negatives." Subjects who are not diseased and who test negative in the assay are termed "true negatives." The "specificity" of a diagnostic assay is 1 minus the false positive rate, where the "false positive" rate is defined as the proportion of those without the disease who test positive. While a particular diagnostic method may not provide a definitive diagnosis of a condition, it suffices if the method provides a positive indication that aids in diagnosis.

As used herein the phrase "diagnosing" refers to classifying a disease or a symptom, determining a severity of the disease, monitoring disease progression, forecasting an outcome of a disease and/or prospects of recovery. The term "detecting" may also optionally encompass any of the above.

Diagnosis of a disease according to the present invention can be effected by determining a level of a polynucleotide or a polypeptide of the present invention in a biological sample obtained from the subject, wherein the level determined can be correlated with predisposition to, or presence or absence of the disease. It should be noted that a "biological sample obtained from the subject" may also optionally comprise a sample that has not been physically removed from the subject, as described in greater detail below.

As used herein, the term "level" refers to expression levels of RNA and/or protein or to DNA copy number of a marker of the present invention.

Typically the level of the marker in a biological sample obtained from the subject is different (i.e., increased or decreased) from the level of the same variant in a similar sample obtained from a healthy individual (examples of biological samples are described herein).

Numerous well known tissue or fluid collection methods can be utilized to collect the biological sample from the subject in order to determine the level of DNA, RNA and/or polypeptide of the variant of interest in the subject.

Examples include, but are not limited to, fine needle biopsy, needle biopsy, core needle biopsy and surgical biopsy (e.g., brain biopsy), and lavage. Regardless of the procedure employed, once a biopsy/sample is obtained the level of the variant can be determined and a diagnosis can thus be made.

Determining the level of the same variant in normal tissues of the same origin is preferably effected along-side to detect an elevated expression and/or amplification and/or a decreased expression, of the variant as opposed to the normal tissues.

A "test amount" of a marker refers to an amount of a marker in a subject's sample that is consistent with a diagnosis of a particular disease or condition. A test amount can be either in absolute amount (e.g., microgram/ml) or a relative amount (e.g., relative intensity of signals).

A "control amount" of a marker can be any amount or a range of amounts to be compared against a test amount of a marker. For example, a control amount of a marker can be the amount of a marker in a patient with a particular disease or condition or a person without such a disease or condition. A control amount can be either in absolute amount (e.g., microgram/ml) or a relative amount (e.g., relative intensity of signals).

"Detect" refers to identifying the presence, absence or amount of the object to be detected.

A "label" includes any moiety or item detectable by spectroscopic, photo chemical, biochemical, immunochemical, or chemical means. For example, useful labels include $^{32}P$, $^{35}S$, fluorescent dyes, electron-dense reagents, enzymes (e.g., as commonly used in an ELISA), biotin-streptavadin, dioxigenin, haptens and proteins for which antisera or monoclonal antibodies are available, or nucleic acid molecules with a sequence complementary to a target. The label often generates a measurable signal, such as a radioactive, chromogenic, or fluorescent signal, that can be used to quantify the amount of bound label in a sample. The label can be incorporated in or attached to a primer or probe either covalently, or through ionic, van der Waals or hydrogen bonds, e.g., incorporation of radioactive nucleotides, or biotinylated nucleotides that are recognized by streptavadin. The label may be directly or indirectly detectable. Indirect detection can involve the binding of a second label to the first label, directly or indirectly. For example, the label can be the ligand of a binding partner, such as biotin, which is a binding partner for streptavadin, or a nucleotide sequence, which is the binding partner for a complementary sequence, to which it can specifically hybridize. The binding partner may itself be directly detectable, for example, an antibody may be itself labeled with a fluorescent molecule. The binding partner also may be indirectly detectable, for example, a nucleic acid having a complementary nucleotide sequence can be a part of a branched DNA molecule that is in turn detectable through hybridization with other labeled nucleic acid molecules (see, e.g., P. D. Fahrlander and A. Klausner, Bio/Technology 6:1165 (1988)). Quantitation of the signal is achieved by, e.g., scintillation counting, densitometry, or flow cytometry.

Exemplary detectable labels, optionally and preferably for use with immunoassays, include but are not limited to magnetic beads, fluorescent dyes, radiolabels, enzymes (e.g., horse radish peroxidase, alkaline phosphatase and others commonly used in an ELISA), and calorimetric labels such as colloidal gold or colored glass or plastic beads. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture. "Immunoassay" is an assay that uses an antibody to specifically bind an antigen. The immunoassay is characterized by the use of specific binding properties of a particular antibody to isolate, target, and/or quantify the antigen.

The phrase "specifically (or selectively) binds" to an antibody or "specifically (or selectively) immunoreactive with," when referring to a protein or peptide (or other epitope), refers to a binding reaction that is determinative of the presence of the protein in a heterogeneous population of proteins and other biologics. Thus, under designated immunoassay conditions, the specified antibodies bind to a particular protein at least two times greater than the background (non-specific signal) and do not substantially bind in a significant amount to other proteins present in the sample. Specific binding to an antibody under such conditions may require an antibody that is selected for its specificity for a particular protein. For example, polyclonal antibodies raised to seminal basic protein from specific species such as rat, mouse, or human can be selected to obtain only those polyclonal antibodies that are specifically immunoreactive with seminal basic protein and not with other proteins, except for polymorphic variants and alleles of seminal basic protein. This selection may be achieved by subtracting out antibodies that cross-react with seminal basic protein molecules from other species. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, Antibodies, A Laboratory Manual (1988), for a description of immunoassay formats and conditions that can be used to determine specific immunoreactivity). Typically a specific or selective reaction will be at least twice background signal or noise and more typically more than 10 to 100 times background.

In another embodiment, the present invention relates to bridges, tails, heads and/or insertions, and/or analogs, homologs and derivatives of such peptides. Such bridges, tails, heads and/or insertions are described in greater detail below with regard to the Examples.

As used herein a "tail" refers to a peptide sequence at the end of an amino acid sequence that is unique to a splice variant according to the present invention. Therefore, a splice variant having such a tail may optionally be considered as a chimera, in that at least a first portion of the splice variant is typically highly homologous (often 100% identical) to a portion of the corresponding known protein, while at least a second portion of the variant comprises the tail.

As used herein a "head" refers to a peptide sequence at the beginning of an amino acid sequence that is unique to a splice variant according to the present invention. Therefore, a splice variant having such a head may optionally be considered as a chimera, in that at least a first portion of the splice variant comprises the head, while at least a second portion is typically highly homologous (often 100% identical) to a portion of the corresponding known protein.

As used herein "an edge portion" refers to a connection between two portions of a splice variant according to the present invention that were not joined in the wild type or known protein. An edge may optionally arise due to a join between the above "known protein" portion of a variant and the tail, for example, and/or may occur if an internal portion of the wild type sequence is no longer present, such that two portions of the sequence are now contiguous in the splice variant that were not contiguous in the known protein. A "bridge" may optionally be an edge portion as described above, but may also include a join between a head and a "known protein" portion of a variant, or a join between a tail and a "known protein" portion of a variant, or a join between an insertion and a "known protein" portion of a variant.

Optionally and preferably, a bridge between a tail or a head or a unique insertion, and a "known protein" portion of a variant, comprises at least about 10 amino acids, more preferably at least about 20 amino acids, most preferably at least about 30 amino acids, and even more preferably at least about 40 amino acids, in which at least one amino acid is from the tail/head/insertion and at least one amino acid is from the "known protein" portion of a variant. Also optionally, the bridge may comprise any number of amino acids from about 10 to about 40 amino acids (for example, 10, 11, 12, 13 . . . 37, 38, 39, 40 amino acids in length, or any number in between).

It should be noted that a bridge cannot be extended beyond the length of the sequence in either direction, and it should be assumed that every bridge description is to be read in such manner that the bridge length does not extend beyond the sequence itself.

Furthermore, bridges are described with regard to a sliding window in certain contexts below. For example, certain descriptions of the bridges feature the following format: a bridge between two edges (in which a portion of the known protein is not present in the variant) may optionally be described as follows: a bridge portion of CONTIG-NAME_P1 (representing the name of the protein), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise XX (2 amino acids in the center of the bridge, one from each end of the edge), having a structure as follows (numbering according to the sequence of CONTIG-NAME_P1): a sequence starting from any of amino acid numbers 49-x to 49 (for example); and ending at any of amino acid numbers 50 +((n-2)-x) (for example), in which x varies from 0 to n-2. In this example, it should also be read as including bridges in which n is any number of amino acids between 10-50 amino acids in length. Furthermore, the bridge polypeptide cannot extend beyond the sequence, so it should be read such that 49-x (for example) is not less than 1, nor 50+((n-2)-x) (for example) greater than the total sequence length.

In another embodiment, this invention provides antibodies specifically recognizing the splice variants and polypeptide fragments thereof of this invention. Preferably such antibodies differentially recognize splice variants of the present invention but do not recognize a corresponding known protein (such known proteins are discussed with regard to their splice variants in the Examples below).

In another embodiment, this invention provides an isolated nucleic acid molecule encoding for a splice variant according to the present invention, having a nucleotide sequence as set forth in any one of the sequences listed herein, or a sequence complementary thereto. In another embodiment, this invention provides an isolated nucleic acid molecule, having a nucleotide sequence as set forth in any one of the sequences listed herein, or a sequence complementary thereto. In another embodiment, this invention provides an oligonucleotide of at least about 12 nucleotides, specifically hybridizable with the nucleic acid molecules of this invention. In another embodiment, this invention provides vectors, cells, liposomes and compositions comprising the isolated nucleic acids of this invention.

In another embodiment, this invention provides a method for detecting a splice variant according to the present invention in a biological sample, comprising: contacting a biological sample with an antibody specifically recognizing a splice variant according to the present invention under conditions whereby the antibody specifically interacts with the splice variant in the biological sample but do not recognize known corresponding proteins (wherein the known protein is discussed with regard to its splice variant(s) in the Examples below), and detecting said interaction; wherein the presence of an interaction correlates with the presence of a splice variant in the biological sample.

In another embodiment, this invention provides a method for detecting a splice variant nucleic acid sequences in a biological sample, comprising: hybridizing the isolated nucleic acid molecules or oligonucleotide fragments of at least about a minimum length to a nucleic acid material of a biological sample and detecting a hybridization complex; wherein the presence of a hybridization complex correlates with the presence of a splice variant nucleic acid sequence in the biological sample.

According to the present invention, the splice variants described herein are non-limiting examples of markers for diagnosing marker-detectable disease and/or an indicative condition. Each splice variant marker of the present invention can be used alone or in combination, for various uses, including but not limited to, prognosis, prediction, screening, early diagnosis, determination of progression, therapy selection and treatment monitoring of marker-detectable disease and/or an indicative condition, including a transition from an indicative condition to marker-detectable disease.

According to the present invention, the splice variants described herein are non-limiting examples of markers for diagnosing marker-detectable disease and/or an indicative condition. Each splice variant marker of the present invention can be used alone or in combination, for various uses, including but not limited to, prognosis, prediction, screening, early diagnosis, determination of progression, therapy selection and treatment monitoring of marker-detectable disease and/or an indicative condition, including a transition from an indicative condition to marker-detectable disease.

According to optional but preferred embodiments of the present invention, any marker according to the present invention may optionally be used alone or combination. Such a combination may optionally comprise a plurality of markers described herein, optionally including any subcombination of markers, and/or a combination featuring at least one other marker, for example a known marker. Furthermore, such a combination may optionally and preferably be used as described above with regard to determining a ratio between a quantitative or semi-quantitative measurement of any marker described herein to any other marker described herein, and/or any other known marker, and/or any other marker. With regard to such a ratio between any marker described herein (or a combination thereof) and a known marker, more preferably the known marker comprises the "known protein" as described in greater detail below with regard to each cluster or gene.

According to other preferred embodiments of the present invention, a splice variant protein or a fragment thereof, or a splice variant nucleic acid sequence or a fragment thereof, may be featured as a biomarker for detecting marker-detectable disease and/or an indicative condition, such that a biomarker may optionally comprise any of the above.

According to still other preferred embodiments, the present invention optionally and preferably encompasses any amino acid sequence or fragment thereof encoded by a nucleic acid sequence corresponding to a splice variant protein as described herein. Any oligopeptide or peptide relating to such an amino acid sequence or fragment thereof may optionally also (additionally or alternatively) be used as a biomarker, including but not limited to the unique amino acid sequences of these proteins that are depicted as tails, heads, insertions, edges or bridges. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to a splice variant of the present invention as described above, optionally for any application.

Non-limiting examples of methods or assays are described below.

The present invention also relates to kits based upon such diagnostic methods or assays.

Panels of markers according to the present invention optionally with one or more known marker(s)

The present invention is of methods, uses, devices and assays for diagnosis of a disease or condition. Optionally a plurality of biomarkers (or markers) may be used with the present invention. The plurality of markers may optionally include a plurality of markers described herein, and/or one or more known markers. The plurality of markers is preferably then correlated with the disease or condition. For example, such correlating may optionally comprise determining the concentration of each of the plurality of markers, and individually comparing each marker concentration to a threshold level. Optionally, if the marker concentration is above or below the threshold level (depending upon the marker and/or the diagnostic test being performed), the marker concentration correlates with the disease or condition. Optionally and preferably, a plurality of marker concentrations correlate with the disease or condition.

Alternatively, such correlating may optionally comprise determining the concentration of each of the plurality of markers, calculating a single index value based on the concentration of each of the plurality of markers, and comparing the index value to a threshold level.

Also alternatively, such correlating may optionally comprise determining a temporal change in at least one of the markers, and wherein the temporal change is used in the correlating step.

Also alternatively, such correlating may optionally comprise determining whether at least "X" number of the plurality of markers has a concentration outside of a predetermined range and/or above or below a threshold (as described above). The value of "X" may optionally be one marker, a plurality of markers or all of the markers; alternatively or additionally, rather than including any marker in the count for "X", one or more specific markers of the plurality of markers may optionally be required to correlate with the disease or condition (according to a range and/or threshold).

Also alternatively, such correlating may optionally comprise determining whether a ratio of marker concentrations for two markers is outside a range and/or above or below a threshold. Optionally, if the ratio is above or below the threshold level and/or outside a range, the ratio correlates with the disease or condition.

Optionally, a combination of two or more these correlations may be used with a single panel and/or for correlating between a plurality of panels.

Optionally, the method distinguishes a disease or condition with a sensitivity of at least 70% at a specificity of at least 85% when compared to normal subjects. As used herein, sensitivity relates to the number of positive (diseased) samples detected out of the total number of positive samples present; specificity relates to the number of true negative (non-diseased) samples detected out of the total number of negative samples present. Preferably, the method distinguishes a disease or condition with a sensitivity of at least 80% at a specificity of at least 90% when compared to normal subjects. More preferably, the method distinguishes a disease or condition with a sensitivity of at least 90% at a specificity of at least 90% when compared to normal subjects. Also more preferably, the method distinguishes a disease or condition with a sensitivity of at least 70% at a specificity of at least 85% when compared to subjects exhibiting symptoms that mimic disease or condition symptoms.

A marker panel may be analyzed in a number of fashions well known to those of skill in the art. For example, each member of a panel may be compared to a "normal" value, or a value indicating a particular outcome. A particular diagnosis/prognosis may depend upon the comparison of each marker to this value; alternatively, if only a subset of markers are outside of a normal range, this subset may be indicative of a particular diagnosis/prognosis. The skilled artisan will also understand that diagnostic markers, differential diagnostic markers, prognostic markers, time of onset markers, disease or condition differentiating markers, etc., may be combined in a single assay or device. Markers may also be commonly used for multiple purposes by, for example, applying a different threshold or a different weighting factor to the marker for the different purpose(s).

Preferred panels comprise markers for the following purposes: diagnosis of a disease; diagnosis of disease and indication if the disease is in an acute phase and/or if an acute attack of the disease has occurred; diagnosis of disease and indication if the disease is in a non-acute phase and/or if a non-acute attack of the disease has occurred; indication whether a combination of acute and non-acute phases or attacks has occurred; diagnosis of a disease and prognosis of a subsequent adverse outcome; diagnosis of a disease and prognosis of a subsequent acute or non-acute phase or attack; disease progression (for example for cancer, such progression may include for example occurrence or recurrence of metastasis).

The above diagnoses may also optionally include differential diagnosis of the disease to distinguish it from other diseases, including those diseases that may feature one or more similar or identical symptoms.

In certain embodiments, one or more diagnostic or prognostic indicators are correlated to a condition or disease by merely the presence or absence of the indicator(s). In other embodiments, threshold level(s) of a diagnostic or prognostic indicator(s) can be established, and the level of the indicator(s) in a patient sample can simply be compared to the threshold level(s). The sensitivity and specificity of a diagnostic and/or prognostic test depends on more than just the analytical "quality" of the test—they also depend on the definition of what constitutes an abnormal result. In practice, Receiver Operating Characteristic curves, or "ROC" curves, are typically calculated by plotting the value of a variable versus its relative frequency in "normal" and "disease" populations, and/or by comparison of results from a subject before, during and/or after treatment. For any particular marker, a distribution of marker levels for subjects with and without a disease will likely overlap. Under such conditions, a test does not absolutely distinguish normal from disease with 100% accuracy, and the area of overlap indicates where the test cannot distinguish normal from disease. A threshold is selected, above which (or below which, depending on how a marker changes with the disease) the test is considered to be abnormal and below which the test is considered to be normal. The area under the ROC curve is a measure of the probability that the perceived measurement will allow correct identification of a condition.

The horizontal axis of the ROC curve represents (1-specificity), which increases with the rate of false positives. The vertical axis of the curve represents sensitivity, which increases with the rate of true positives. Thus, for a particular cutoff selected, the value of (1-specificity) may be determined, and a corresponding sensitivity may be obtained. The area under the ROC curve is a measure of the probability that the measured marker level will allow correct identification of a disease or condition. Thus, the area under the ROC curve can be used to determine the effectiveness of the test.

ROC curves can be used even when test results don't necessarily give an accurate number. As long as one can rank results, one can create an ROC curve. For example, results of a test on "disease" samples might be ranked according to degree (say 1=low, 2=normal, and 3=high). This ranking can be correlated to results in the "normal" population, and a ROC curve created. These methods are well known in the art (see for example Hanley et al., Radiology 143: 29-36 (1982), incorporated by reference as if fully set forth herein).

One or more markers may lack diagnostic or prognostic value when considered alone, but when used as part of a panel, such markers may be of great value in determining a particular diagnosis/prognosis. In preferred embodiments, particular thresholds for one or more markers in a panel are not relied upon to determine if a profile of marker levels obtained from a subject are indicative of a particular diagnosis/prognosis. Rather, the present invention may utilize an evaluation of the entire marker profile by plotting ROC curves for the sensitivity of a particular panel of markers versus 1-(specificity) for the panel at various cutoffs. In these methods, a profile of marker measurements from a subject is considered together to provide a global probability (expressed either as a numeric score or as a percentage risk) that an individual has had a disease, is at risk for developing such a disease, optionally the type of disease which the individual has had or is at risk for, and so forth etc. In such embodiments, an increase in a certain subset of markers may be sufficient to indicate a particular diagnosis/prognosis in one patient, while an increase in a different subset of markers may be sufficient to indicate the same or a different diagnosis/prognosis in another patient. Weighting factors may also be applied to one or more markers in a panel, for example, when a marker is of particularly high utility in identifying a particular diagnosis/prognosis, it may be weighted so that at a given level it alone is sufficient to signal a positive result. Likewise, a weighting factor may provide that no given level of a particular marker is sufficient to signal a positive result, but only signals a result when another marker also contributes to the analysis.

In preferred embodiments, markers and/or marker panels are selected to exhibit at least 70% sensitivity, more preferably at least 80% sensitivity, even more preferably at least 85% sensitivity, still more preferably at least 90% sensitivity, and most preferably at least 95% sensitivity, combined with at least 70% specificity, more preferably at least 80% specificity, even more preferably at least 85% specificity, still more preferably at least 90% specificity, and most preferably at least 95% specificity. In particularly preferred embodiments, both the sensitivity and specificity are at least 75%, more preferably at least 80%, even more preferably at least 85%, still more preferably at least 90%, and most preferably at least 95%. Sensitivity and/or specificity may optionally be determined as described above, with regard to the construction of ROC graphs and so forth, for example.

According to preferred embodiments of the present invention, individual markers and/or combinations (panels) of markers may optionally be used for diagnosis of time of onset of a disease or condition. Such diagnosis may optionally be useful for a wide variety of conditions, preferably including those conditions with an abrupt onset.

The phrase "determining the prognosis" as used herein refers to methods by which the skilled artisan can predict the course or outcome of a condition in a patient. The term "prognosis" does not refer to the ability to predict the course or outcome of a condition with 100% accuracy, or even that a given course or outcome is more likely to occur than not. Instead, the skilled artisan will understand that the term "prognosis" refers to an increased probability that a certain course or outcome will occur; that is, that a course or outcome is more likely to occur in a patient exhibiting a given condition, when compared to those individuals not exhibiting the condition. For example, in individuals not exhibiting the condition, the chance of a given outcome may be about 3%. In preferred embodiments, a prognosis is about a 5% chance of a given outcome, about a 7% chance, about a 10% chance, about a 12% chance, about a 15% chance, about a 20% chance, about a 25% chance, about a 30% chance, about a 40% chance, about a 50% chance, about a 60% chance, about a 75% chance, about a 90% chance, and about a 95% chance. The term "about" in this context refers to ±1%.

The skilled artisan will understand that associating a prognostic indicator with a predisposition to an adverse outcome is a statistical analysis. For example, a marker level of greater than 80 pg/mL may signal that a patient is more likely to suffer from an adverse outcome than patients with a level less than or equal to 80 pg/mL, as determined by a level of statistical significance. Additionally, a change in marker concentration from baseline levels may be reflective of patient prognosis, and the degree of change in marker level may be related to the severity of adverse events. Statistical significance is often determined by comparing two or more populations, and determining a confidence interval and/or a p value. See, e.g., Dowdy and Wearden, Statistics for Research, John Wiley & Sons, New York, 1983. Preferred confidence intervals of the invention are 90%, 95%, 97.5%, 98%, 99%, 99.5%, 99.9% and 99.99%, while preferred p values are 0.1, 0.05, 0.025, 0.02, 0.01, 0.005, 0.001, and 0.0001. Exemplary statistical tests for associating a prognostic indicator with a predisposition to an adverse outcome are described hereinafter.

In other embodiments, a threshold degree of change in the level of a prognostic or diagnostic indicator can be established, and the degree of change in the level of the indicator in a patient sample can simply be compared to the threshold degree of change in the level. A preferred threshold change in the level for markers of the invention is about 5%, about 10%, about 15%, about 20%, about 25%, about 30%, about 50%, about 75%, about 100%, and about 150%. The term "about" in this context refers to ±10%. In yet other embodiments, a "nomogram" can be established, by which a level of a prognostic or diagnostic indicator can be directly related to an associated disposition towards a given outcome. The skilled artisan is acquainted with the use of such nomograms to relate two numeric values with the understanding that the uncertainty in this measurement is the same as the uncertainty in the marker concentration because individual sample measurements are referenced, not population averages.

Exemplary, non-limiting methods and systems for identification of suitable biomarkers for marker panels are now described. Methods and systems for the identification of one or more markers for the diagnosis, and in particular for the differential diagnosis, of disease have been described previously. Suitable methods for identifying markers useful for the diagnosis of disease states are described in detail in U.S. patent application no. 2004-0126767, entitled METHOD AND SYSTEM FOR DISEASE DETECTION USING MARKER COMBINATIONS, filed Dec. 27, 2002, hereby incorporated by reference in its entirety as if fully set forth herein. One skilled in the art will also recognize that univariate analysis of markers can be performed and the data from the univariate analyses of multiple markers can be combined to form panels of markers to differentiate different disease conditions.

In developing a panel of markers useful in diagnosis, data for a number of potential markers may be obtained from a group of subjects by testing for the presence or level of certain markers. The group of subjects is divided into two sets, and preferably the first set and the second set each have an approximately equal number of subjects. The first set includes subjects who have been confirmed as having a disease or, more generally, being in a first condition state. For example, this first set of patients may be those that have recently had a disease and/or a particular type of the disease. The confirmation of this condition state may be made through more rigorous and/or expensive testing, preferably according to a previously defined diagnostic standard. Hereinafter, subjects in this first set will be referred to as "diseased".

The second set of subjects are simply those who do not fall within the first set. Subjects in this second set may be "non-diseased;" that is, normal subjects. Alternatively, subjects in this second set may be selected to exhibit one symptom or a constellation of symptoms that mimic those symptoms exhibited by the "diseased" subjects.

The data obtained from subjects in these sets includes levels of a plurality of markers. Preferably, data for the same set of markers is available for each patient. This set of markers may include all candidate markers which may be suspected as being relevant to the detection of a particular disease or condition. Actual known relevance is not required. Embodiments of the methods and systems described herein may be used to determine which of the candidate markers are most relevant to the diagnosis of the disease or condition. The levels of each marker in the two sets of subjects may be distributed across a broad range, e.g., as a Gaussian distribution. However, no distribution fit is required.

As noted above, a marker often is incapable of definitively identifying a patient as either diseased or non-diseased. For example, if a patient is measured as having a marker level that falls within the overlapping region, the results of the test will be useless in diagnosing the patient. An artificial cutoff may be used to distinguish between a positive and a negative test result for the detection of the disease or condition. Regardless of where the cutoff is selected, the effectiveness of the single marker as a diagnosis tool is unaffected. Changing the cutoff merely trades off between the number of false positives and the number of false negatives resulting from the use of the single marker. The effectiveness of a test having such an overlap is often expressed using a ROC (Receiver Operating Characteristic) curve as described above.

As discussed above, the measurement of the level of a single marker may have limited usefulness. The measurement of additional markers provides additional information, but the difficulty lies in properly combining the levels of two potentially unrelated measurements. In the methods and systems according to embodiments of the present invention, data relating to levels of various markers for the sets of diseased and non-diseased patients may be used to develop a panel of markers to provide a useful panel response. The data may be provided in a database such as Microsoft Access, Oracle, other SQL databases or simply in a data file. The database or data file may contain, for example, a patient identifier such as a name or number, the levels of the various markers present, and whether the patient is diseased or non-diseased.

Next, an artificial cutoff region may be initially selected for each marker. The location of the cutoff region may initially be selected at any point, but the selection may affect the optimization process described below. In this regard, selection near a suspected optimal location may facilitate faster convergence of the optimizer. In a preferred method, the cutoff region is initially centered about the center of the overlap region of the two sets of patients. In one embodiment, the cutoff region may simply be a cutoff point. In other embodiments, the cutoff region may have a length of greater than zero. In this regard, the cutoff region may be defined by a center value and a magnitude of length. In practice, the initial selection of the limits of the cutoff region may be determined according to a pre-selected percentile of each set of subjects. For example, a point above which a pre-selected percentile of diseased patients are measured may be used as the right (upper) end of the cutoff range.

Each marker value for each patient may then be mapped to an indicator. The indicator is assigned one value below the cutoff region and another value above the cutoff region. For example, if a marker generally has a lower value for non-diseased patients and a higher value for diseased patients, a zero indicator will be assigned to a low value for a particular marker, indicating a potentially low likelihood of a positive diagnosis. In other embodiments, the indicator may be calculated based on a polynomial. The coefficients of the polynomial may be determined based on the distributions of the marker values among the diseased and non-diseased subjects.

The relative importance of the various markers may be indicated by a weighting factor. The weighting factor may initially be assigned as a coefficient for each marker. As with the cutoff region, the initial selection of the weighting factor may be selected at any acceptable value, but the selection may affect the optimization process. In this regard, selection near a suspected optimal location may facilitate faster convergence of the optimizer. In a preferred method, acceptable weighting coefficients may range between zero and one, and an initial weighting coefficient for each marker may be assigned as 0.5. In a preferred embodiment, the initial weighting coefficient for each marker may be associated with the effectiveness of that marker by itself. For example, a ROC curve may be generated for the single marker, and the area under the ROC curve may be used as the initial weighting coefficient for that marker.

Next, a panel response may be calculated for each subject in each of the two sets. The panel response is a function of the indicators to which each marker level is mapped and the weighting coefficients for each marker. One advantage of using an indicator value rather than the marker value is that an extraordinarily high or low marker levels do not change the probability of a diagnosis of diseased or non-diseased for that particular marker. Typically, a marker value above a certain level generally indicates a certain condition state. Marker values above that level indicate the condition state with the same certainty. Thus, an extraordinarily high marker value may not indicate an extraordinarily high probability of that condition state. The use of an indicator which is constant on one side of the cutoff region eliminates this concern.

The panel response may also be a general function of several parameters including the marker levels and other factors including, for example, race and gender of the patient. Other factors contributing to the panel response may include the slope of the value of a particular marker over time. For example, a patient may be measured when first arriving at the hospital for a particular marker. The same marker may be measured again an hour later, and the level of change may be reflected in the panel response. Further, additional markers may be derived from other markers and may contribute to the value of the panel response. For example, the ratio of values of two markers may be a factor in calculating the panel response.

Having obtained panel responses for each subject in each set of subjects, the distribution of the panel responses for each set may now be analyzed. An objective function may be defined to facilitate the selection of an effective panel. The objective function should generally be indicative of the effectiveness of the panel, as may be expressed by, for example, overlap of the panel responses of the diseased set of subjects and the panel responses of the non-diseased set of subjects. In this manner, the objective function may be optimized to maximize the effectiveness of the panel by, for example, minimizing the overlap.

In a preferred embodiment, the ROC curve representing the panel responses of the two sets of subjects may be used to define the objective function. For example, the objective function may reflect the area under the ROC curve. By maximizing the area under the curve, one may maximize the effectiveness of the panel of markers. In other embodiments, other features of the ROC curve may be used to define the objective function. For example, the point at which the slope of the ROC curve is equal to one may be a useful feature. In other embodiments, the point at which the product of sensitivity and specificity is a maximum, sometimes referred to as the "knee," may be used. In an embodiment, the sensitivity at the knee may be maximized. In further embodiments, the sensitivity at a predetermined specificity level may be used to define the objective function. Other embodiments may use the specificity at a predetermined sensitivity level may be used. In still other embodiments, combinations of two or more of these ROC-curve features may be used.

It is possible that one of the markers in the panel is specific to the disease or condition being diagnosed. When such markers are present at above or below a certain threshold, the panel response may be set to return a "positive" test result. When the threshold is not satisfied, however, the levels of the marker may nevertheless be used as possible contributors to the objective function.

An optimization algorithm may be used to maximize or minimize the objective function. Optimization algorithms are well-known to those skilled in the art and include several commonly available minimizing or maximizing functions including the Simplex method and other constrained optimization techniques. It is understood by those skilled in the art that some minimization functions are better than others at searching for global minimums, rather than local minimums. In the optimization process, the location and size of the cutoff region for each marker may be allowed to vary to provide at least two degrees of freedom per marker. Such variable parameters are referred to herein as independent variables. In a preferred embodiment, the weighting coefficient for each marker is also allowed to vary across iterations of the optimization algorithm. In various embodiments, any permutation of these parameters may be used as independent variables.

In addition to the above-described parameters, the sense of each marker may also be used as an independent variable. For example, in many cases, it may not be known whether a higher level for a certain marker is generally indicative of a diseased state or a non-diseased state. In such a case, it may be useful to allow the optimization process to search on both sides. In practice, this may be implemented in several ways. For example, in one embodiment, the sense may be a truly separate independent variable which may be flipped between positive and negative by the optimization process. Alternatively, the sense may be implemented by allowing the weighting coefficient to be negative.

The optimization algorithm may be provided with certain constraints as well. For example, the resulting ROC curve may be constrained to provide an area-under-curve of greater than a particular value. ROC curves having an area under the curve of 0.5 indicate complete randomness, while an area under the curve of 1.0 reflects perfect separation of the two sets. Thus, a minimum acceptable value, such as 0.75, may be used as a constraint, particularly if the objective function does not incorporate the area under the curve. Other constraints may include limitations on the weighting coefficients of particular markers. Additional constraints may limit the sum of all the weighting coefficients to a particular value, such as 1.0.

The iterations of the optimization algorithm generally vary the independent parameters to satisfy the constraints while minimizing or maximizing the objective function. The number of iterations may be limited in the optimization process. Further, the optimization process may be terminated when the difference in the objective function between two consecutive iterations is below a predetermined threshold, thereby indicating that the optimization algorithm has reached a region of a local minimum or a maximum.

Thus, the optimization process may provide a panel of markers including weighting coefficients for each marker and cutoff regions for the mapping of marker values to indicators. In order to develop lower-cost panels which require the measurement of fewer marker levels, certain markers may be eliminated from the panel. In this regard, the effective contribution of each marker in the panel may be determined to identify the relative importance of the markers. In one embodiment, the weighting coefficients resulting from the optimization process may be used to determine the relative importance of each marker. The markers with the lowest coefficients may be eliminated.

Individual panel response values may also be used as markers in the methods described herein. For example, a panel may be constructed from a plurality of markers, and each marker of the panel may be described by a function and a weighting factor to be applied to that marker (as determined by the methods described above). Each individual marker level is determined for a sample to be tested, and that level is applied to the predetermined function and weighting factor for that particular marker to arrive at a sample value for that marker. The sample values for each marker are added together to arrive at the panel response for that particular sample to be tested. For a "diseased" and "non-diseased" group of patients, the resulting panel responses may be treated as if they were just levels of another disease marker.

Measures of test accuracy may be obtained as described in Fischer et al., Intensive Care Med. 29: 1043-51, 2003 (hereby incorporated by reference as if fully set forth herein), and used to determine the effectiveness of a given marker or panel of markers. These measures include sensitivity and specificity, predictive values, likelihood ratios, diagnostic odds ratios, and ROC curve areas. As discussed above, suitable tests may exhibit one or more of the following results on these various measures: at least 75% sensitivity, combined with at least 75% specificity; ROC curve area of at least 0.7, more preferably at least 0.8, even more preferably at least 0.9, and most preferably at least 0.95; and/or a positive likelihood ratio (calculated as sensitivity/(1-specificity)) of at least 5, more preferably at least 10, and most preferably at least 20, and a negative likelihood ratio (calculated as (1-sensitivity)/specificity) of less than or equal to 0.3, more preferably less than or equal to 0.2, and most preferably less than or equal to 0.1.

Nucleic Acid Sequences and Oligonucleotides:

Various embodiments of the present invention encompass nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or artificially induced, either randomly or in a targeted fashion.

The present invention encompasses nucleic acid sequences described herein; fragments thereof, sequences hybridizable therewith, sequences homologous thereto [e.g., at least 50%, at least 55%, at least 60%, at least 65%, at least 70%, at least 75%, at least 80%, at least 85%, at least 95% or more say 100% identical to the nucleic acid sequences set forth below], sequences encoding similar polypeptides with different codon usage, altered sequences characterized by mutations, such as deletion, insertion or substitution of one or more nucleotides, either naturally occurring or man induced, either randomly or in a targeted fashion. The present invention also encompasses homologous nucleic acid sequences (i.e., which form a part of a polynucleotide sequence of the present invention) which include sequence regions unique to the polynucleotides of the present invention.

In cases where the polynucleotide sequences of the present invention encode previously unidentified polypeptides, the present invention also encompasses novel polypeptides or portions thereof, which are encoded by the isolated polynucleotide and respective nucleic acid fragments thereof described hereinabove.

A "nucleic acid fragment" or an "oligonucleotide" or a "polynucleotide" are used herein interchangeably to refer to a polymer of nucleic acids. A polynucleotide sequence of the present invention refers to a single or double stranded nucleic acid sequences which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is composed of genomic and cDNA sequences. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Preferred embodiments of the present invention encompass oligonucleotide probes.

An example of an oligonucleotide probe which can be utilized by the present invention is a single stranded polynucleotide which includes a sequence complementary to the unique sequence region of any variant according to the present invention, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Alternatively, an oligonucleotide probe of the present invention can be designed to hybridize with a nucleic acid sequence encompassed by any of the above nucleic acid sequences, particularly the portions specified above, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Oligonucleotides designed according to the teachings of the present invention can be generated according to any oligonucleotide synthesis method known in the art such as enzymatic synthesis or solid phase synthesis. Equipment and reagents for executing solid-phase synthesis are commercially available from, for example, Applied Biosystems. Any other means for such synthesis may also be employed; the actual synthesis of the oligonucleotides is well within the capabilities of one skilled in the art and can be accomplished via established methodologies as detailed in, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Maryland (1989); Perbal, "A Practical Guide to Molecular Cloning", John Wiley & Sons, New York (1988) and "Oligonucleotide Synthesis" Gait, M. J., ed. (1984) utilizing solid phase chemistry, e.g. cyanoethyl phosphoramidite followed by deprotection, desalting and purification by for example, an automated trityl-on method or HPLC.

Oligonucleotides used according to this aspect of the present invention are those having a length selected from a range of about 10 to about 200 bases preferably about 15 to about 150 bases, more preferably about 20 to about 100 bases, most preferably about 20 to about 50 bases. Preferably, the oligonucleotide of the present invention features at least 17, at least 18, at least 19, at least 20, at least 22, at least 25, at least 30 or at least 40, bases specifically hybridizable with the biomarkers of the present invention.

The oligonucleotides of the present invention may comprise heterocylic nucleosides consisting of purines and the pyrimidines bases, bonded in a 3' to 5' phosphodiester linkage.

Preferably used oligonucleotides are those modified at one or more of the backbone, internucleoside linkages or bases, as is broadly described hereinunder.

Specific examples of preferred oligonucleotides useful according to this aspect of the present invention include oligonucleotides containing modified backbones or non-natural internucleoside linkages. Oligonucleotides having modified backbones include those that retain a phosphorus atom in the backbone, as disclosed in U.S. Pat. Nos.: 4,469,863; 4,476, 301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466, 677; 5,476,925; 5,519,126; 5,536,821; 5,541,306; 5,550,111; 5,563,253; 5,571,799; 5,587,361; and 5,625,050.

Preferred modified oligonucleotide backbones include, for example, phosphorothioates, chiral phosphorothioates, phosphorodithioates, phosphotriesters, aminoalkyl phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms can used.

Alternatively, modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts, as disclosed in U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623, 070; 5,663,312; 5,633,360; 5,677,437; and 5,677,439.

Other oligonucleotides which can be used according to the present invention, are those modified in both sugar and the internucleoside linkage, i.e., the backbone, of the nucleotide units are replaced with novel groups. The base units are maintained for complementation with the appropriate polynucleotide target. An example for such an oligonucleotide mimetic, includes peptide nucleic acid (PNA). United States patents that teach the preparation of PNA compounds include, but are not limited to, U.S. Pat. Nos. 5,539,082; 5,714,331; and 5,719,262, each of which is herein incorporated by reference. Other backbone modifications, which can be used in the present invention are disclosed in U.S. Pat. No: 6,303,374.

Oligonucleotides of the present invention may also include base modifications or substitutions. As used herein, "unmodified" or "natural" bases include the purine bases adenine (A) and guanine (G), and the pyrimidine bases thymine (T), cytosine (C) and uracil (U). Modified bases include but are not limited to other synthetic and natural bases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further bases particularly useful for increasing the binding affinity of the oligomeric compounds of the invention include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. and are presently preferred base substitutions, even more particularly when combined with 2'-O-methoxyethyl sugar modifications.

Another modification of the oligonucleotides of the invention involves chemically linking to the oligonucleotide one or more moieties or conjugates, which enhance the activity, cellular distribution or cellular uptake of the oligonucleotide. Such moieties include but are not limited to lipid moieties such as a cholesterol moiety, cholic acid, a thioether, e.g., hexyl-S-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxycholesterol moiety, as disclosed in U.S. Pat. No: 6,303,374.

It is not necessary for all positions in a given oligonucleotide molecule to be uniformly modified, and in fact more than one of the aforementioned modifications may be incorporated in a single compound or even at a single nucleoside within an oligonucleotide.

It will be appreciated that oligonucleotides of the present invention may include further modifications for more efficient use as diagnostic agents and/or to increase bioavailability, therapeutic efficacy and reduce cytotoxicity.

To enable cellular expression of the polynucleotides of the present invention, a nucleic acid construct according to the present invention may be used, which includes at least a coding region of one of the above nucleic acid sequences, and further includes at least one cis acting regulatory element. As used herein, the phrase "cis acting regulatory element" refers to a polynucleotide sequence, preferably a promoter, which binds a trans acting regulator and regulates the transcription of a coding sequence located downstream thereto.

Any suitable promoter sequence can be used by the nucleic acid construct of the present invention.

Preferably, the promoter utilized by the nucleic acid construct of the present invention is active in the specific cell population transformed. Examples of cell type-specific and/or tissue-specific promoters include promoters such as albumin that is liver specific, lymphoid specific promoters [Calame et al., (1988) Adv. Immunol. 43:235-275]; in particular promoters of T-cell receptors [Winoto et al., (1989) EMBO J. 8:729-733] and immunoglobulins; [Banerji et al. (1983) Cell 33729-740], neuron-specific promoters such as the neurofilament promoter [Byrne et al. (1989) Proc. Natl. Acad. Sci. USA 86:5473-5477], pancreas-specific promoters [Edlunch et al. (1985) Science 230:912-916] or mammary gland-specific promoters such as the milk whey promoter (U.S. Pat. No. 4,873,316 and European Application Publication No. 264, 166). The nucleic acid construct of the present invention can further include an enhancer, which can be adjacent or distant to the promoter sequence and can function in up regulating the transcription therefrom.

The nucleic acid construct of the present invention preferably further includes an appropriate selectable marker and/or an origin of replication. Preferably, the nucleic acid construct utilized is a shuttle vector, which can propagate both in *E. coli* (wherein the construct comprises an appropriate selectable marker and origin of replication) and be compatible for propagation in cells, or integration in a gene and a tissue of choice. The construct according to the present invention can be, for example, a plasmid, a bacmid, a phagemid, a cosmid, a phage, a virus or an artificial chromosome.

Examples of suitable constructs include, but are not limited to, pcDNA3, pcDNA3.1 (±), pGL3, PzeoSV2 (±), pDisplay, pEF/myc/cyto, pCMV/myc/cyto each of which is commercially available from Invitrogen Co. (.invitrogen.com). Examples of retroviral vector and packaging systems are those sold by Clontech, San Diego, Calif., including Retro-X vectors pLNCX and pLXSN, which permit cloning into multiple cloning sites and the trasgene is transcribed from CMV promoter. Vectors derived from Mo-MuLV are also included such as pBabe, where the transgene will be transcribed from the 5'LTR promoter.

Currently preferred in vivo nucleic acid transfer techniques include transfection with viral or non-viral constructs, such as adenovirus, lentivirus, Herpes simplex I virus, or adeno-associated virus (AAV) and lipid-based systems. Useful lipids for lipid-mediated transfer of the gene are, for example, DOTMA, DOPE, and DC-Chol [Tonkinson et al., Cancer Investigation, 14(1): 54-65 (1996)]. The most preferred constructs for use in gene therapy are viruses, most preferably adenoviruses, AAV, lentiviruses, or retroviruses. A viral construct such as a retroviral construct includes at least one transcriptional promoter/enhancer or locus-defining element(s), or other elements that control gene expression by other means such as alternate splicing, nuclear RNA export, or post-translational modification of messenger. Such vector constructs also include a packaging signal, long terminal repeats (LTRs) or portions thereof, and positive and negative strand primer binding sites appropriate to the virus used, unless it is already present in the viral construct. In addition, such a construct typically includes a signal sequence for secretion of the peptide from a host cell in which it is placed. Preferably the signal sequence for this purpose is a mammalian signal sequence or the signal sequence of the polypeptide variants of the present invention. Optionally, the construct may also include a signal that directs polyadenylation, as well as one or more restriction sites and a translation termination sequence. By way of example, such constructs will typically include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

Hybridization Assays:

Detection of a nucleic acid of interest in a biological sample may optionally be effected by hybridization-based assays using an oligonucleotide probe (non-limiting examples of probes according to the present invention were previously described).

Traditional hybridization assays include PCR, RT-PCR, Real-time PCR, RNase protection, in-situ hybridization, primer extension, Southern blots (DNA detection),.or slot blots (DNA, RNA), and Northern blots (RNA detection) (NAT type assays are described in greater detail below). More recently, PNAs have been described (Nielsen et al. 1999, Current Opin. Biotechnol. 10:71-75). Other detection methods include kits containing probes on a dipstick setup and the like.

Hybridization based assays which allow the detection of a variant of interest (i.e., DNA or RNA) in a biological sample rely on the use of oligonucleotides which can be 10, 15, 20, or 30 to 100 nucleotides long preferably from 10 to 50, more preferably from 40 to 50 nucleotides long.

Thus, the isolated polynucleotides (oligonucleotides) of the present invention are preferably hybridizable with any of the herein described nucleic acid sequences under moderate to stringent hybridization conditions.

Moderate to stringent hybridization conditions are characterized by a hybridization solution such as containing 10% dextrane sulfate, 1 M NaCl, 1% SDS and $5 \times 10^6$ cpm $^{32}$P labeled probe, at 65° C., with a final wash solution of 0.2× SSC and 0.1% SDS and final wash at 65° C. and whereas moderate hybridization is effected using a hybridization solution containing 10% dextrane sulfate, 1 M NaCl, 1% SDS and $5 \times 10^6$ cpm $^{32}$P labeled probe, at 65° C., with a final wash solution of 1×SSC and 0.1% SDS and final wash at 50° C.

More generally, hybridization of short nucleic acids (below 200 bp in length, e.g. 17-40 bp in length) can be effected using the following exemplary hybridization protocols which can be modified according to the desired stringency; (i) hybridization solution of 6×SSC and 1% SDS or 3 M TMACI, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 1-1.5° C. below the $T_m$, final wash solution of 3 M TMACI, 0.01 M sodium phosphate (pH 6.8), 1 mM EDTA (pH 7.6), 0.5% SDS at 1-1.5° C. below the $T_m$; (ii) hybridization solution of 6×SSC and 0.1% SDS or 3 M TMACI, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 2-2.5° C. below the Tm, final wash solution of 3 M TMACI, 0.01 M sodium phosphate (pH 6.8), 1 mM EDTA (pH 7.6), 0.5% SDS at 1-1.5° C. below the Tm, final wash solution of 6×SSC, and final wash at 22° C.; (iii) hybridization solution of 6×SSC and 1% SDS or 3 M TMACI, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature.

The detection of hybrid duplexes can be carried out by a number of methods. Typically, hybridization duplexes are separated from unhybridized nucleic acids and the labels bound to the duplexes are then detected. Such labels refer to radioactive, fluorescent, biological or enzymatic tags or labels of standard use in the art. A label can be conjugated to either the oligonucleotide probes or the nucleic acids derived from the biological sample.

Probes can be labeled according to numerous well known methods. Non-limiting examples of radioactive labels include 3H, 14C, 32P, and 35S. Non-limiting examples of detectable markers include ligands, fluorophores, chemiluminescent agents, enzymes, and antibodies. Other detectable markers for use with probes, which can enable an increase in sensitivity of the method of the invention, include biotin and radio-nucleotides. It will become evident to the person of ordinary skill that the choice of a particular label dictates the manner in which it is bound to the probe.

For example, oligonucleotides of the present invention can be labeled subsequent to synthesis, by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent. Alternatively, when fluorescently-labeled oligonucleotide probes are used, fluorescein, lissamine, phycoerythrin, rhodamine (Perkin Elmer Cetus), Cy2, Cy3, Cy3.5, Cy5, Cy5.5, Cy7, FluorX (Amersham) and others [e.g., Kricka et al. (1992), Academic Press San Diego, Calif.] can be attached to the oligonucleotides.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays. For instance, samples may be hybridized to an irrelevant probe and treated with RNAse A prior to hybridization, to assess false hybridization.

Although the present invention is not specifically dependent on the use of a label for the detection of a particular nucleic acid sequence, such a label might be beneficial, by increasing the sensitivity of the detection. Furthermore, it enables automation. Probes can be labeled according to numerous well known methods.

As commonly known, radioactive nucleotides can be incorporated into probes of the invention by several methods. Non-limiting examples of radioactive labels include $^3$H, $^{14}$C, $^{32}$P, and $^{35}$S.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays.

Probes of the invention can be utilized with naturally occurring sugar-phosphate backbones as well as modified backbones including phosphorothioates, dithionates, alkyl phosphonates and a-nucleotides and the like. Probes of the invention can be constructed of either ribonucleic acid (RNA) or deoxyribonucleic acid (DNA), and preferably of DNA.

NAT Assays:

Detection of a nucleic acid of interest in a biological sample may also optionally be effected by NAT-based assays, which involve nucleic acid amplification technology, such as PCR for example (or variations thereof such as real-time PCR for example).

As used herein, a "primer" defines an oligonucleotide which is capable of annealing to (hybridizing with) a target sequence, thereby creating a double stranded region which can serve as an initiation point for DNA synthesis under suitable conditions.

Amplification of a selected, or target, nucleic acid sequence may be carried out by a number of suitable methods. See generally Kwoh et al., 1990, Am. Biotechnol. Lab. 8:14 Numerous amplification techniques have been described and can be readily adapted to suit particular needs of a person of ordinary skill. Non-limiting examples of amplification techniques include polymerase chain reaction (PCR), ligase chain reaction (LCR), strand displacement amplification (SDA), transcription-based amplification, the q3 replicase system and NASBA (Kwoh et al., 1989, Proc. Natl. Acad. Sci. USA 86, 1173-1177; Lizardi et al., 1988, BioTechnology 6:1197-1202; Malek et al., 1994, Methods Mol. Biol., 28:253-260; and Sambrook et al., 1989, supra).

The terminology "amplification pair" (or "primer pair") refers herein to a pair of oligonucleotides (oligos) of the present invention, which are selected to be used together in amplifying a selected nucleic acid sequence by one of a number of types of amplification processes, preferably a polymerase chain reaction. Other types of amplification processes include ligase chain reaction, strand displacement amplification, or nucleic acid sequence-based amplification, as explained in greater detail below. As commonly known in the art, the oligos are designed to bind to a complementary sequence under selected conditions.

In one particular embodiment, amplification of a nucleic acid sample from a patient is amplified under conditions which favor the amplification of the most abundant differentially expressed nucleic acid. In one preferred embodiment, RT-PCR is carried out on an mRNA sample from a patient under conditions which favor the amplification of the most abundant mRNA. In another preferred embodiment, the amplification of the differentially expressed nucleic acids is carried out simultaneously. It will be realized by a person skilled in the art that such methods could be adapted for the detection of differentially expressed proteins instead of differentially expressed nucleic acid sequences.

The nucleic acid (i.e. DNA or RNA) for practicing the present invention may be obtained according to well known methods.

Oligonucleotide primers of the present invention may be of any suitable length, depending on the particular assay format and the particular needs and targeted genomes employed. Optionally, the oligonucleotide primers are at least 12 nucleotides in length, preferably between 15 and 24 molecules, and they may be adapted to be especially suited to a chosen nucleic acid amplification system. As commonly known in the art, the oligonucleotide primers can be designed by taking into consideration the melting point of hybridization thereof with its targeted sequence (Sambrook et al., 1989, Molecular Cloning -A Laboratory Manual, 2nd Edition, CSH Laboratories; Ausubel et al., 1989, in Current Protocols in Molecular Biology, John Wiley & Sons Inc., N.Y.).

It will be appreciated that antisense oligonucleotides may be employed to quantify expression of a splice isoform of interest. Such detection is effected at the pre-mRNA level. Essentially the ability to quantitate transcription from a splice site of interest can be effected based on splice site accessibility. Oligonucleotides may compete with splicing factors for the splice site sequences. Thus, low activity of the antisense oligonucleotide is indicative of splicing activity.

The polymerase chain reaction and other nucleic acid amplification reactions are well known in the art (various non-limiting examples of these reactions are described in greater detail below). The pair of oligonucleotides according to this aspect of the present invention are preferably selected to have compatible melting temperatures (Tm), e.g., melting temperatures which differ by less than that 7° C., preferably less than 5° C., more preferably less than 4° C., most preferably less than 3° C., ideally between 3° C. and 0° C.

Polymerase Chain Reaction (PCR): The polymerase chain reaction (PCR), as described in U.S. Pat. Nos. 4,683,195 and 4,683,202 to Mullis and Mullis et al., is a method of increasing the concentration of a segment of target sequence in a mixture of genomic DNA without cloning or purification. This technology provides one approach to the problems of low target sequence concentration. PCR can be used to directly increase the concentration of the target to an easily detectable level. This process for amplifying the target sequence involves the introduction of a molar excess of two oligonucleotide primers which are complementary to their respective strands of the double-stranded target sequence to the DNA mixture containing the desired target sequence. The mixture is denatured and then allowed to hybridize. Following hybridization, the primers are extended with polymerase so as to form complementary strands. The steps of denaturation, hybridization (annealing), and polymerase extension (elongation) can be repeated as often as needed, in order to obtain relatively high concentrations of a segment of the desired target sequence.

The length of the segment of the desired target sequence is determined by the relative positions of the primers with respect to each other, and, therefore, this length is a controllable parameter. Because the desired segments of the target sequence become the dominant sequences (in terms of concentration) in the mixture, they are said to be "PCR-amplified."

Ligase Chain Reaction (LCR or LAR): The ligase chain reaction [LCR; sometimes referred to as "Ligase Amplification Reaction" (LAR)] has developed into a well-recognized alternative method of amplifying nucleic acids. In LCR, four oligonucleotides, two adjacent oligonucleotides which uniquely hybridize to one strand of target DNA, and a complementary set of adjacent oligonucleotides, which hybridize to the opposite strand are mixed and DNA ligase is added to the mixture. Provided that there is complete complementarity at the junction, ligase will covalently link each set of hybridized molecules. Importantly, in LCR, two probes are ligated together only when they base-pair with sequences in the target sample, without gaps or mismatches. Repeated cycles of denaturation, and ligation amplify a short segment of DNA. LCR has also been used in combination with PCR to achieve enhanced detection of single-base changes: see for example Segev, PCT Publication No. W09001069 A1 (1990). However, because the four oligonucleotides used in this assay can pair to form two short ligatable fragments, there is the potential for the generation of target-independent background signal. The use of LCR for mutant screening is limited to the examination of specific nucleic acid positions.

Self-Sustained Synthetic Reaction (3SR/NASBA): The self-sustained sequence replication reaction (3SR) is a transcription-based in vitro amplification system that can exponentially amplify RNA sequences at a uniform temperature. The amplified RNA can then be utilized for mutation detection. In this method, an oligonucleotide primer is used to add a phage RNA polymerase promoter to the 5' end of the sequence of interest. In a cocktail of enzymes and substrates that includes a second primer, reverse transcriptase, RNase H, RNA polymerase and ribo-and deoxyribonucleoside triphosphates, the target sequence undergoes repeated rounds of transcription, cDNA synthesis and second-strand synthesis to amplify the area of interest. The use of 3SR to detect mutations is kinetically limited to screening small segments of DNA (e.g., 200-300 base pairs).

Q-Beta (Qβ) Replicase: In this method, a probe which recognizes the sequence of interest is attached to the replicatable RNA template for Qβ replicase. A previously identified major problem with false positives resulting from the replication of unhybridized probes has been addressed through use of a sequence-specific ligation step. However, available thermostable DNA ligases are not effective on this RNA substrate, so the ligation must be performed by T4 DNA ligase at low temperatures (37 degrees C.). This prevents the use of high temperature as a means of achieving specificity as in the LCR, the ligation event can be used to detect a mutation at the junction site, but not elsewhere.

A successful diagnostic method must be very specific. A straight-forward method of 25 controlling the specificity of nucleic acid hybridization is by controlling the temperature of the reaction. While the 3SR/NASBA, and Qβ systems are all able to generate a large quantity of signal, one or more of the enzymes involved in each cannot be used at high temperature (i.e., >55 degrees C.). Therefore the reaction temperatures cannot be raised to prevent non-specific hybridization of the probes. If probes are shortened in order to make them melt more easily at low temperatures, the likelihood of having more than one perfect match in a complex genome increases. For these reasons, PCR and LCR currently dominate the research field in detection technologies.

The basis of the amplification procedure in the PCR and LCR is the fact that the products of one cycle become usable templates in all subsequent cycles, consequently doubling the population with each cycle. The final yield of any such doubling system can be expressed as: $(1+X)^n=y$, where "X" is the mean efficiency (percent copied in each cycle), "n" is the number of cycles, and "y" is the overall efficiency, or yield of the reaction. If every copy of a target DNA is utilized as a template in every cycle of a polymerase chain reaction, then the mean efficiency is 100%. If 20 cycles of PCR are performed, then the yield will be $2^{20}$, or 1,048,576 copies of the starting material. If the reaction conditions reduce the mean efficiency to 85%, then the yield in those 20 cycles will be only $1.85^{20}$, or 220,513 copies of the starting material. In other words, a PCR running at 85% efficiency will yield only 21% as much final product, compared to a reaction running at 100% efficiency. A reaction that is reduced to 50% mean efficiency will yield less than 1% of the possible product.

In practice, routine polymerase chain reactions rarely achieve the theoretical maximum yield, and PCRs are usually run for more than 20 cycles to compensate for the lower yield. At 50% mean efficiency, it would take 34 cycles to achieve the million-fold amplification theoretically possible in 20, and at lower efficiencies, the number of cycles required becomes prohibitive. In addition, any background products that amplify with a better mean efficiency than the intended target will become the dominant products.

Also, many variables can influence the mean efficiency of PCR, including target DNA length and secondary structure, primer length and design, primer and dNTP concentrations, and buffer composition, to name but a few. Contamination of the reaction with exogenous DNA (e.g., DNA spilled onto lab surfaces) or cross-contamination is also a major consideration. Reaction conditions must be carefully optimized for each different primer pair and target sequence, and the process can take days, even for an experienced investigator. The laboriousness of this process, including numerous technical considerations and other factors, presents a significant drawback to using PCR in the clinical setting. Indeed, PCR has yet to penetrate the clinical market in a significant way. The same concerns arise with LCR, as LCR must also be optimized to use different oligonucleotide sequences for each target sequence. In addition, both methods require expensive equipment, capable of precise temperature cycling.

Many applications of nucleic acid detection technologies, such as in studies of allelic variation, involve not only detection of a specific sequence in a complex background, but also the discrimination between sequences with few, or single, nucleotide differences. One method of the detection of allele-specific variants by PCR is based upon the fact that it is difficult for Taq polymerase to synthesize a DNA strand when there is a mismatch between the template strand and the 3' end of the primer. An allele-specific variant may be detected by the use of a primer that is perfectly matched with only one of the possible alleles; the mismatch to the other allele acts to prevent the extension of the primer, thereby preventing the amplification of that sequence. This method has a substantial limitation in that the base composition of the mismatch influences the ability to prevent extension across the mismatch, and certain mismatches do not prevent extension or have only a minimal effect.

A similar 3'-mismatch strategy is used with greater effect to prevent ligation in the LCR. Any mismatch effectively blocks the action of the thermostable ligase, but LCR still has the drawback of target-independent background ligation products initiating the amplification. Moreover, the combination of PCR with subsequent LCR to identify the nucleotides at individual positions is also a clearly cumbersome proposition for the clinical laboratory.

The direct detection method according to various preferred embodiments of the present invention may be, for example a cycling probe reaction (CPR) or a branched DNA analysis.

When a sufficient amount of a nucleic acid to be detected is available, there are advantages to detecting that sequence directly, instead of making more copies of that target, (e.g., as in PCR and LCR). Most notably, a method that does not amplify the signal exponentially is more amenable to quantitative analysis. Even if the signal is enhanced by attaching multiple dyes to a single oligonucleotide, the correlation between the final signal intensity and amount of target is direct. Such a system has an additional advantage that the products of the reaction will not themselves promote further reaction, so contamination of lab surfaces by the products is not as much of a concern. Recently devised techniques have sought to eliminate the use of radioactivity and/or improve the sensitivity in automatable formats. Two examples are the "Cycling Probe Reaction" (CPR), and "Branched DNA" (bDNA).

Cycling probe reaction (CPR): The cycling probe reaction (CPR), uses a long chimeric oligonucleotide in which a central portion is made of RNA while the two termini are made of DNA. Hybridization of the probe to a target DNA and exposure to a thermostable RNase H causes the RNA portion to be digested. This destabilizes the remaining DNA portions of the duplex, releasing the remainder of the probe from the target DNA and allowing another probe molecule to repeat the process. The signal, in the form of cleaved probe molecules, accumulates at a linear rate. While the repeating process increases the signal, the RNA portion of the oligonucleotide is vulnerable to RNases that may carried through sample preparation.

Branched DNA: Branched DNA (bDNA), involves oligonucleotides with branched structures that allow each individual oligonucleotide to carry 35 to 40 labels (e.g., alkaline phosphatase enzymes). While this enhances the signal from a hybridization event, signal from non-specific binding is similarly increased.

The detection of at least one sequence change according to various preferred embodiments of the present invention may be accomplished by, for example restriction fragment length polymorphism (RFLP analysis), allele specific oligonucleotide (ASO) analysis, Denaturing/Temperature Gradient Gel Electrophoresis (DGGE/TGGE), Single-Strand Conformation Polymorphism (SSCP) analysis or Dideoxy fingerprinting (ddF).

The demand for tests which allow the detection of specific nucleic acid sequences and sequence changes is growing rapidly in clinical diagnostics. As nucleic acid sequence data for genes from humans and pathogenic organisms accumulates, the demand for fast, cost-effective, and easy-to-use tests for as yet mutations within specific sequences is rapidly increasing.

A handful of methods have been devised to scan nucleic acid segments for mutations. One option is to determine the entire gene sequence of each test sample (e.g., a bacterial isolate). For sequences under approximately 600 nucleotides, this may be accomplished using amplified material (e.g., PCR reaction products). This avoids the time and expense associated with cloning the segment of interest. However, specialized equipment and highly trained personnel are required, and the method is too labor-intense and expensive to be practical and effective in the clinical setting.

In view of the difficulties associated with sequencing, a given segment of nucleic acid may be characterized on several other levels. At the lowest resolution, the size of the molecule can be determined by electrophoresis by comparison to a known standard run on the same gel. A more detailed picture of the molecule may be achieved by cleavage with combinations of restriction enzymes prior to electrophoresis, to allow construction of an ordered map. The presence of specific sequences within the fragment can be detected by hybridization of a labeled probe, or the precise nucleotide sequence can be determined by partial chemical degradation or by primer extension in the presence of chain-terminating nucleotide analogs.

Restriction fragment length polymorphism (RFLP): For detection of single-base differences between like sequences, the requirements of the analysis are often at the highest level of resolution. For cases in which the position of the nucleotide in question is known in advance, several methods have been developed for examining single base changes without direct sequencing. For example, if a mutation of interest happens to fall within a restriction recognition sequence, a change in the pattern of digestion can be used as a diagnostic tool (e.g., restriction fragment length polymorphism [RFLP] analysis).

Single point mutations have been also detected by the creation or destruction of RFLPs. Mutations are detected and localized by the presence and size of the RNA fragments generated by cleavage at the mismatches. Single nucleotide mismatches in DNA heteroduplexes are also recognized and cleaved by some chemicals, providing an alternative strategy to detect single base substitutions, generically named the "Mismatch Chemical Cleavage" (MCC). However, this method requires the use of osmium tetroxide and piperidine, two highly noxious chemicals which are not suited for use in a clinical laboratory.

RFLP analysis suffers from low sensitivity and requires a large amount of sample. When RFLP analysis is used for the detection of point mutations, it is, by its nature, limited to the detection of only those single base changes which fall within a restriction sequence of a known restriction endonuclease. Moreover, the majority of the available enzymes have 4 to 6 base-pair recognition sequences, and cleave too frequently for many large-scale DNA manipulations. Thus, it is applicable only in a small fraction of cases, as most mutations do not fall within such sites.

A handful of rare-cutting restriction enzymes with 8 base-pair specificities have been isolated and these are widely used in genetic mapping, but these enzymes are few in number, are limited to the recognition of G+C-rich sequences, and cleave at sites that tend to be highly clustered. Recently, endonucleases encoded by group I introns have been discovered that might have greater than 12 base-pair specificity, but again, these are few in number.

Allele specific oligonucleotide (ASO): If the change is not in a recognition sequence, then allele-specific oligonucleotides (ASOs), can be designed to hybridize in proximity to the mutated nucleotide, such that a primer extension or ligation event can bused as the indicator of a match or a mismatch. Hybridization with radioactively labeled allelic specific oligonucleotides (ASO) also has been applied to the detection of specific point mutations. The method is based on the differences in the melting temperature of short DNA fragments differing by a single nucleotide. Stringent hybridization and washing conditions can differentiate between mutant and wild-type alleles. The ASO approach applied to PCR products also has been extensively utilized by various researchers to detect and characterize point mutations in ras genes and gsp/gip oncogenes. Because of the presence of various nucleotide changes in multiple positions, the ASO method requires the use of many oligonucleotides to cover all possible oncogenic mutations.

With either of the techniques described above (i.e., RFLP and ASO), the precise location of the suspected mutation must be known in advance of the test. That is to say, they are inapplicable when one needs to detect the presence of a mutation within a gene or sequence of interest.

Denaturing/Temperature Gradient Gel Electrophoresis (DGGE/TGGE): Two other methods rely on detecting changes in electrophoretic mobility in response to minor sequence changes. One of these methods, termed "Denaturing Gradient Gel Electrophoresis" (DGGE) is based on the observation that slightly different sequences will display different patterns of local melting when electrophoretically resolved on a gradient gel. In this manner, variants can be distinguished, as differences in melting properties of homoduplexes versus heteroduplexes differing in a single nucleotide can detect the presence of mutations in the target sequences because of the corresponding changes in their electrophoretic mobilities. The fragments to be analyzed, usually PCR products, are "clamped" at one end by a long stretch of G-C base pairs (30-80) to allow complete denaturation of the sequence of interest without complete dissociation of the strands. The attachment of a GC "clamp" to the DNA fragments increases the fraction of mutations that can be recognized by DGGE. Attaching a GC clamp to one primer is critical to ensure that the amplified sequence has a low dissociation temperature. Modifications of the technique have been developed, using temperature gradients, and the method can be also applied to RNA:RNA duplexes.

Limitations on the utility of DGGE include the requirement that the denaturing conditions must be optimized for each type of DNA to be tested. Furthermore, the method requires specialized equipment to prepare the gels and maintain the needed high temperatures during electrophoresis. The expense associated with the synthesis of the clamping tail on one oligonucleotide for each sequence to be tested is also a major consideration. In addition, long running times are required for DGGE. The long running time of DGGE was shortened in a modification of DGGE called constant denaturant gel electrophoresis (CDGE). CDGE requires that gels be performed under different denaturant conditions in order to reach high efficiency for the detection of mutations.

A technique analogous to DGGE, termed temperature gradient gel electrophoresis (TGGE), uses a thermal gradient rather than a chemical denaturant gradient. TGGE requires the use of specialized equipment which can generate a temperature gradient perpendicularly oriented relative to the electrical field. TGGE can detect mutations in relatively small fragments of DNA therefore scanning of large gene segments requires the use of multiple PCR products prior to running the gel.

Single-Strand Conformation Polymorphism (SSCP): Another common method, called "Single-Strand Conformation Polymorphism" (SSCP) was developed by Hayashi, Sekya and colleagues and is based on the observation that single strands of nucleic acid can take on characteristic conformations in non-denaturing conditions, and these conformations influence electrophoretic mobility. The complementary strands assume sufficiently different structures that one strand may be resolved from the other. Changes in sequences within the fragment will also change the conformation, consequently altering the mobility and allowing this to be used as an assay for sequence variations.

The SSCP process involves denaturing a DNA segment (e.g., a PCR product) that is labeled on both strands, followed by slow electrophoretic separation on a non-denaturing polyacrylamide gel, so that intra-molecular interactions can form and not be disturbed during the run. This technique is extremely sensitive to variations in gel composition and temperature. A serious limitation of this method is the relative difficulty encountered in comparing data generated in different laboratories, under apparently similar conditions.

Dideoxy fingerprinting (ddF): The dideoxy fingerprinting (ddF) is another technique developed to scan genes for the presence of mutations. The ddF technique combines components of Sanger dideoxy sequencing with SSCP. A dideoxy sequencing reaction is performed using one dideoxy terminator and then the reaction products are electrophoresed on nondenaturing polyacrylamide gels to detect alterations in mobility of the termination segments as in SSCP analysis. While ddF is an improvement over SSCP in terms of increased sensitivity, ddF requires the use of expensive dideoxynucleotides and this technique is still limited to the analysis of fragments of the size suitable for SSCP (i.e., fragments of 200-300 bases for optimal detection of mutations).

In addition to the above limitations, all of these methods are limited as to the size of the nucleic acid fragment that can be analyzed. For the direct sequencing approach, sequences of greater than 600 base pairs require cloning, with the consequent delays and expense of either deletion sub-cloning or primer walking, in order to cover the entire fragment. SSCP and DGGE have even more severe size limitations. Because of reduced sensitivity to sequence changes, these methods are not considered suitable for larger fragments. Although SSCP is reportedly able to detect 90% of single-base substitutions within a 200 base-pair fragment, the detection drops to less than 50% for 400 base pair fragments. Similarly, the sensitivity of DGGE decreases as the length of the fragment reaches 500 base-pairs. The ddF technique, as a combination of direct sequencing and SSCP, is also limited by the relatively small size of the DNA that can be screened.

According to a presently preferred embodiment of the present invention the step of searching for any of the nucleic acid sequences described here, in tumor cells or in cells derived from a cancer patient is effected by any suitable technique, including, but not limited to, nucleic acid sequencing, polymerase chain reaction, ligase chain reaction, self-sustained synthetic reaction, Qβ-Replicase, cycling probe reaction, branched DNA, restriction fragment length polymorphism analysis, mismatch chemical cleavage, heteroduplex analysis, allele-specific oligonucleotides, denaturing gradient gel electrophoresis, constant denaturant gel electrophoresis, temperature gradient gel electrophoresis and dideoxy fingerprinting.

Detection may also optionally be performed with a chip or other such device. The nucleic acid sample which includes the candidate region to be analyzed is preferably isolated, amplified and labeled with a reporter group. This reporter group can be a fluorescent group such as phycoerythrin. The labeled nucleic acid is then incubated with the probes immobilized on the chip using a fluidics station. describe the fabrication of fluidics devices and particularly microcapillary devices, in silicon and glass substrates.

Once the reaction is completed, the chip is inserted into a scanner and patterns of hybridization are detected. The hybridization data is collected, as a signal emitted from the reporter groups already incorporated into the nucleic acid, which is now bound to the probes attached to the chip. Since the sequence and position of each probe immobilized on the chip is known, the identity of the nucleic acid hybridized to a given probe can be determined.

It will be appreciated that when utilized along with automated equipment, the above described detection methods can be used to screen multiple samples for a disease and/or pathological condition both rapidly and easily.

Amino Acid Sequences and Peptides:

The terms "polypeptide," "peptide" and "protein" are used interchangeably herein to refer to a polymer of amino acid residues. The terms apply to amino acid polymers in which one or more amino acid residue is an analog or mimetic of a corresponding naturally occurring amino acid, as well as to naturally occurring amino acid polymers. Polypeptides can be modified, e.g., by the addition of carbohydrate residues to form glycoproteins. The terms "polypeptide," "peptide" and "protein" include glycoproteins, as well as non-glycoproteins.

Polypeptide products can be biochemically synthesized such as by employing standard solid phase techniques. Such methods include but are not limited to exclusive solid phase synthesis, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Solid phase polypeptide synthesis procedures are well known in the art and further described by John Morrow Stewart and Janis Dillaha Young, Solid Phase Peptide Syntheses (2nd Ed., Pierce Chemical Company, 1984).

Synthetic polypeptides can optionally be purified by preparative high performance liquid chromatography [Creighton T. (1983) Proteins, structures and molecular principles. WH Freeman and Co. N.Y.], after which their composition can be confirmed via amino acid sequencing.

In cases where large amounts of a polypeptide are desired, it can be generated using recombinant techniques such as described by Bitter et al., (1987) Methods in Enzymol. 153:516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463.

The present invention also encompasses polypeptides encoded by the polynucleotide sequences of the present invention, as well as polypeptides according to the amino acid sequences described herein. The present invention also encompasses homologues of these polypeptides, such homologues can be at least 50%, at least 55%, at least 60%, at least 65%, at least 70%, at least 75%, at least 80%, at least 85%, at least 95% or more say 100% homologous to the amino acid sequences set forth below, as can be determined using BlastP software of the National Center of Biotechnology Information (NCBI) using default parameters, optionally and preferably including the following: filtering on (this option filters repetitive or low-complexity sequences from the query using the Seg (protein) program), scoring matrix is BLOSUM62 for proteins, word size is 3, E value is 10, gap costs are 11, 1 (initialization and extension), and number of alignments shown is 50. Preferably, nucleic acid sequence homology/identity is determined by using BlastN software of the National Center of Biotechnology Information (NCBI) using default parameters, which preferably include using the DUST filter program, and also preferably include having an E value of 10, filtering low complexity sequences and a word size of 11. Finally, the present invention also encompasses fragments of the above described polypeptides and polypeptides having mutations, such as deletions, insertions or substitutions of one or more amino acids, either naturally occurring or artificially induced, either randomly or in a targeted fashion.

It will be appreciated that peptides identified according to the present invention may be degradation products, synthetic peptides or recombinant peptides as well as peptidomimetics, typically, synthetic peptides and peptoids and semipeptoids which are peptide analogs, which may have, for example, modifications rendering the peptides more stable while in a body or more capable of penetrating into cells. Such modifications include, but are not limited to N terminus modification, C terminus modification, peptide bond modification, including, but not limited to, CH2-NH, CH2-S, CH2-S=O, O=C—NH, CH2-O, CH2-CH2, S=C—NH, CH=CH or CF=CH, backbone modifications, and residue modification. Methods for preparing peptidomimetic compounds are well known in the art and are specified. Further details in this respect are provided hereinunder.

Peptide bonds (—CO—NH—) within the peptide may be substituted, for example, by N-methylated bonds (—N(CH3)-CO—), ester bonds (—C(R)H—C—O—O—C(R)—N—), ketomethylen bonds (—CO—CH2-), α-aza bonds (—NH—N(R)—CO—), wherein R is any alkyl, e.g., methyl, carba bonds (—CH2-NH—), hydroxyethylene bonds (—CH(OH)—CH2-), thioamide bonds (—CS—NH—), olefinic double bonds (—CH=CH—), retro amide bonds (—NH—CO—), peptide derivatives (—N(R)—CH2-CO—), wherein R is the "normal" side chain, naturally presented on the carbon atom.

These modifications can occur at any of the bonds along the peptide chain and even at several (2-3) at the same time.

Natural aromatic amino acids, Trp, Tyr and Phe, may be substituted for synthetic non-natural acid such as Phenylglycine, TIC, naphthylelanine (Nol), ring-methylated derivatives of Phe, halogenated derivatives of Phe or o-methyl-Tyr.

In addition to the above, the peptides of the present invention may also include one or more modified amino acids or one or more non-amino acid monomers (e.g. fatty acids, complex carbohydrates etc).

As used herein in the specification and in the claims section below the term "amino acid" or "amino acids" is understood to include the 20 naturally occurring amino acids; those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine. Furthermore, the term "amino acid" includes both D- and L-amino acids.

Table 1 non-conventional or modified amino acids which can be used with the present invention.

TABLE 1

| Non-conventional amino acid | Code | Non-conventional amino acid | Code |
| --- | --- | --- | --- |
| α-aminobutyric acid | Abu | L-N-methylalanine | Nmala |
| α-amino-α-methylbutyrate | Mgabu | L-N-methylarginine | Nmarg |
| aminocyclopropane-Carboxylate | Cpro | L-N-methylasparagine | Nmasn |
|  |  | L-N-methylaspartic acid | Nmasp |
| aminoisobutyric acid | Aib | L-N-methylcysteine | Nmcys |
| aminonorbornyl-Carboxylate | Norb | L-N-methylglutamine | Nmgln |
|  |  | L-N-methylglutamic acid | Nmglu |
| Cyclohexylalanine | Chexa | L-N-methylhistidine | Nmhis |
| Cyclopentylalanine | Cpen | L-N-methylisolleucine | Nmile |
| D-alanine | Dal | L-N-methylleucine | Nmleu |
| D-arginine | Darg | L-N-methyllysine | Nmlys |
| D-aspartic acid | Dasp | L-N-methylmethionine | Nmmet |
| D-cysteine | Dcys | L-N-methylnorleucine | Nmnle |
| D-glutamine | Dgln | L-N-methylnorvaline | Nmnva |
| D-glutamic acid | Dglu | L-N-methylornithine | Nmorn |
| D-histidine | Dhis | L-N-methylphenylalanine | Nmphe |
| D-isoleucine | Dile | L-N-methylproline | Nmpro |
| D-leucine | Dleu | L-N-methylserine | Nmser |
| D-lysine | Dlys | L-N-methylthreonine | Nmthr |

TABLE 1-continued

| Non-conventional amino acid | Code | Non-conventional amino acid | Code |
|---|---|---|---|
| D-methionine | Dmet | L-N-methyltryptophan | Nmtrp |
| D-ornithine | Dorn | L-N-methyltyrosine | Nmtyr |
| D-phenylalanine | Dphe | L-N-methylvaline | Nmval |
| D-proline | Dpro | L-N-methylethylglycine | Nmetg |
| D-serine | Dser | L-N-methyl-t-butylglycine | Nmtbug |
| D-threonine | Dthr | L-norleucine | Nle |
| D-tryptophan | Dtrp | L-norvaline | Nva |
| D-tyrosine | Dtyr | α-methyl-aminoisobutyrate | Maib |
| D-valine | Dval | α-methyl-γ-aminobutyrate | Mgabu |
| D-α-methylalanine | Dmala | α-methylcyclohexylalanine | Mchexa |
| D-α-methylarginine | Dmarg | α-methylcyclopentylalanine | Mcpen |
| D-α-methylasparagine | Dmasn | α-methyl-α-napthylalanine | Manap |
| D-α-methylaspartate | Dmasp | α-methylpenicillamine | Mpen |
| D-α-methylcysteine | Dmcys | N-(4-aminobutyl)glycine | Nglu |
| D-α-methylglutamine | Dmgln | N-(2-aminoethyl)glycine | Naeg |
| D-α-methylhistidine | Dmhis | N-(3-aminopropyl)glycine | Norn |
| D-α-methylisoleucine | Dmile | N-amino-α-methylbutyrate | Nmaabu |
| D-α-methylleucine | Dmleu | α-napthylalanine | Anap |
| D-α-methyllysine | Dmlys | N-benzylglycine | Nphe |
| D-α-methylmethionine | Dmmet | N-(2-carbamylethyl)glycine | Ngln |
| D-α-methylornithine | Dmorn | N-(carbamylmethyl)glycine | Nasn |
| D-α-methylphenylalanine | Dmphe | N-(2-carboxyethyl)glycine | Nglu |
| D-α-methylproline | Dmpro | N-(carboxymethyl)glycine | Nasp |
| D-α-methylserine | Dmser | N-cyclobutylglycine | Ncbut |
| D-α-methylthreonine | Dmthr | N-cycloheptylglycine | Nchep |
| D-α-methyltryptophan | Dmtrp | N-cyclohexylglycine | Nchex |
| D-α-methyltyrosine | Dmty | N-cyclodecylglycine | Ncdec |
| D-α-methylvaline | Dmval | N-cyclododeclglycine | Ncdod |
| D-α-methylalnine | Dnmala | N-cyclooctylglycine | Ncoct |
| D-α-methylarginine | Dnmarg | N-cyclopropylglycine | Ncpro |
| D-α-methylasparagine | Dnmasn | N-cycloundecylglycine | Ncund |
| D-α-methylasparatate | Dnmasp | N-(2,2-diphenylethyl)glycine | Nbhm |
| D-α-methylcysteine | Dnmcys | N-(3,3-diphenylpropyl)glycine | Nbhe |
| D-N-methylleucine | Dnmleu | N-(3-indolylyethyl) glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nva |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomophenylalanine | Mhphe |
| L-α-methylisoleucine | Mile | N-(2-methylthioethyl)glycine | Nmet |
| D-N-methylglutamine | Dnmgln | N-(3-guanidinopropyl)glycine | Narg |
| D-N-methylglutamate | Dnmglu | N-(1-hydroxyethyl)glycine | Nthr |
| D-N-methylhistidine | Dnmhis | N-(hydroxyethyl)glycine | Nser |
| D-N-methylisoleucine | Dnmile | N-(imidazolylethyl)glycine | Nhis |
| D-N-methylleucine | Dnmleu | N-(3-indolylyethyl)glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nval |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |

TABLE 1-continued

| Non-conventional amino acid | Code | Non-conventional amino acid | Code |
|---|---|---|---|
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomophenylalanine | Mhphe |
| L-α-methylisoleucine | Mile | N-(2-methylthioethyl)glycine | Nmet |
| L-α-methylleucine | Mleu | L-α-methyllysine | Mlys |
| L-α-methylmethionine | Mmet | L-α-methylnorleucine | Mnle |
| L-α-methylnorvaline | Mnva | L-α-methylornithine | Morn |
| L-α-methylphenylalanine | Mphe | L-α-methylproline | Mpro |
| L-α-methylserine | mser | L-α-methylthreonine | Mthr |
| L-α-methylvaline | Mtrp | L-α-methyltyrosine | Mtyr |
| L-α-methylleucine | Mval | L-N-methylhomophenylalanine | Nmhphe |
| N-(N-(2,2-diphenylethyl) carbamylmethyl-glycine | Nnbhm Nnbhm | N-(N-(3,3-diphenylpropyl) carbamylmethyl(1)glycine | Nnbhe |
| 1-carboxy-1-(2,2-diphenyl ethylamino)cyclopropane | Nmbc | | |

Since the peptides of the present invention are preferably utilized in diagnostics which require the peptides to be in soluble form, the peptides of the present invention preferably include one or more non-natural or natural polar amino acids, including but not limited to serine and threonine which are capable of increasing peptide solubility due to their hydroxyl-containing side chain.

The peptides of the present invention are preferably utilized in a linear form, although it will be appreciated that in cases where cyclicization does not severely interfere with peptide characteristics, cyclic forms of the peptide can also be utilized.

The peptides of present invention can be biochemically synthesized such as by using standard solid phase techniques. These methods include exclusive solid phase synthesis well known in the art, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Synthetic peptides can be purified by preparative high performance liquid chromatography and the composition of which can be confirmed via amino acid sequencing.

In cases where large amounts of the peptides of the present invention are desired, the peptides of the present invention can be generated using recombinant techniques such as described by Bitter et al., (1987) Methods in Enzymol. 153:516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463 and also as described above.

Antibodies:

"Antibody" refers to a polypeptide ligand that is preferably substantially encoded by an immunoglobulin gene or immunoglobulin genes, or fragments thereof, which specifically binds and recognizes an epitope (e.g., an antigen). The recognized immunoglobulin genes include the kappa and lambda light chain constant region genes, the alpha, gamma, delta, epsilon and mu heavy chain constant region genes, and the myriad-immunoglobulin variable region genes. Antibodies exist, e.g., as intact immunoglobulins or as a number of well characterized fragments produced by digestion with various peptidases. This includes, e.g., Fab' and F(ab)'$_2$ fragments. The term "antibody," as used herein, also includes antibody fragments either produced by the modification of whole antibodies or those synthesized de novo using recombinant DNA methodologies. It also includes polyclonal antibodies, monoclonal antibodies, chimeric antibodies, humanized antibodies, or single chain antibodies. "Fc" portion of an antibody refers to that portion of an immunoglobulin heavy chain that comprises one or more heavy chain constant region domains, CH1, CH2 and CH3, but does not include the heavy chain variable region.

The functional fragments of antibodies, such as Fab, F(ab')2, and Fv that are capable of binding to macrophages, are described as follows: (1) Fab, the fragment which contains a monovalent antigen-binding fragment of an antibody molecule, can be produced by digestion of whole antibody with the enzyme papain to yield an intact light chain and a portion of one heavy chain; (2) Fab', the fragment of an antibody molecule that can be obtained by treating whole antibody with pepsin, followed by reduction, to yield an intact light chain and a portion of the heavy chain; two Fab' fragments are obtained per antibody molecule; (3) (Fab')2, the fragment of the antibody that can be obtained by treating whole antibody with the enzyme pepsin without subsequent reduction; F(ab')2 is a dimer of two Fab' fragments held together by two disulfide bonds; (4) Fv, defined as a genetically engineered fragment containing the variable region of the light chain and the variable region of the heavy chain expressed as two chains; and (5) Single chain antibody ("SCA"), a genetically engineered molecule containing the variable region of the light chain and the variable region of the heavy chain, linked by a suitable polypeptide linker as a genetically fused single chain molecule.

Methods of producing polyclonal and monoclonal antibodies as well as fragments thereof are well known in the art (See for example, Harlow and Lane, Antibodies: A Laboratory Manual, Cold Spring Harbor Laboratory, New York, 1988, incorporated herein by reference).

Monoclonal antibody development may optionally be performed according to any method that is known in the art. The method described below is provided for the purposes of description only and is not meant to be limiting in any way.

Step 1: Immunization of Mice and Selection of Mouse Donors for Generation of Hybridoma Cells:

Producing mAb requires immunizing an animal, usually a mouse, by injection of an antigen X to stimulate the production of antibodies targeted against X. Antigen X can be the whole protein or any sequence thereof that gives rise to a determinant. According to the present invention, optionally and preferably such antigens may include but are not limited to any variant described herein or a portion thereof, including but not limited to any head, tail, bridge or unique insertion, or a bridge to such head, tail or unique insertion, or any other epitope described herein according to the present invention. Injection of peptides requires peptide design (with respect to protein homology, antigenicity, hydrophilicity, and synthetic suitability) and synthesis. The antigen is optionally and preferably prepared for injection either by emulsifying the antigen with Freund's adjuvant or other adjuvants or by homogenizing a gel slice that contains the antigen. Intact cells, whole membranes, and microorganisms are sometimes optionally used as immunogens. Other immunogens or adjuvants may also optionally be used.

In general, mice are immunized every 2-3 weeks but the immunization protocols are heterogeneous. When a sufficient antibody titer is reached in serum, immunized mice are euthanized and the spleen removed to use as a source of cells for fusion with myeloma cells.

Step 2: Screening of Mice for Antibody Production

After several weeks of immunization, blood samples are optionally and preferably obtained from mice for measurement of serum antibodies. Several techniques have been developed for collection of small volumes of blood from mice (Loeb and Quimby 1999). Serum antibody titer is determined with various techniques, such as enzyme-linked immunosorbent assay (ELISA) and flow cytometry, and/or immunoassays for example (for example a Western blot may optionally be used). If the antibody titer is high, cell fusion can optionally be performed. If the titer is too low, mice can optionally be boosted until an adequate response is achieved, as determined by repeated blood sampling. When the antibody titer is high enough, mice are commonly boosted by injecting antigen without adjuvant intraperitoneally or intravenously (via the tail veins) 3 days before fusion but 2 weeks after the previous immunization. Then the mice are euthanized and their spleens removed for in vitro hybridoma cell production.

Step 3: Preparation of Myeloma Cells

Fusing antibody-producing spleen cells, which have a limited life span, with cells derived from an immortal tumor of lymphocytes (myeloma) results in a hybridoma that is capable of unlimited growth. Myeloma cells are immortalized cells that are optionally and preferably cultured with 8-azaguanine to ensure their sensitivity to the hypoxanthine-aminopterin-thymidine (HAT) selection medium used after cell fusion. The selection growth medium contains the inhibitor aminopterin, which blocks synthetic pathways by which nucleotides are made. Therefore, the cells must use a bypass pathway to synthesize nucleic acids, a pathway that is defective in the myeloma cell line to which the normal antibody-producing cells are fused. Because neither the myeloma nor the antibody-producing cell will grow on its own, only hybrid cells grow. The HAT medium allows only the fused cells to survive in culture. A week before cell fusion, myeloma cells are grown in 8-azaguanine. Cells must have high viability and rapid growth.

The antibody forming cells are isolated from the mouse's spleen and are then fused with a cancer cell (such as cells from a myeloma) to make them immortal, which means that they will grow and divide indefinitely. The resulting cell is called a hybridoma.

Step 4: Fusion of Myeloma Cells with Immune Spleen Cells and antibody screening

Single spleen cells from the immunized mouse are fused with the previously prepared myeloma cells. Fusion is accomplished by co-centrifuging freshly harvested spleen cells and myeloma cells in polyethylene glycol, a substance that causes cell membranes to fuse. Alternatively, the cells are centrifuged, the supernatant is discarded and PEG is then added. The cells are then distributed to 96 well plates containing feeder cells derived from saline peritoneal washes of mice. Feeder cells are believed to supply growth factors that promote growth of the hybridoma cells (Quinlan and Kennedy 1994). Commercial preparations that result from the collection of media supporting the growth of cultured cells and contain growth factors are available that can be used in lieu of mouse-derived feeder cells. It is also possible to use murine bone marrow-derived macrophages as feeder cells (Hoffman and others 1996).

Once hybridoma colonies reach a satisfactory cell count, the plates are assayed by an assay, eg ELISA or a regular immunoassay such as RIA for example, to determine which colonies are secreting antibodies to the immunogen. Cells from positive wells are isolated and expanded. Conditioned medium from each colony is retested to verify the stability of the hybridomas (that is, they continue to produce antibody).

Step 5: Cloning of Hybridoma Cell Lines by "Limiting Dilution" or Expansion and Stabilization of Clones by Ascites Production At this step new, small clusters of hybridoma cells from the 96 well plates can be grown in tissue culture followed by selection for antigen binding or grown by the mouse ascites method with cloning at a later time.

For prolonged stability of the antibody-producing cell lines, it is necessary to clone and then recline the chosen cells. Cloning consists of subcloonng the cells by either limiting dilution at an average of less than one cell in each culture well or by platingout the cells in a thin layer of semisolid agar of methyl cellulose or by single-cell manipulation. At each stage, cultures are assayed for production of the appropriate antibodies.

Step 6: Antibody Purification

The secreted antibodies are optionally purified, preferably by one or more column chromatography steps and/or some other purification method, including but not limited to ion exchange, affinity, hydrophobic interaction, and gel permeation chromatography. The operation of the individual chromatography step, their number and their sequence is generally tailored to the specific antibody and the specific application.

Large-scale antibody production may also optionally and preferably be performed according to the present invention. Two non-limiting, illustrative exemplary methods are described below for the purposes of description only and are not meant to be limiting in any way.

In vivo production may optionally be performed with ascites fluid in mice. According to this method, hybridoma cell lines are injected into the peritoneal cavity of mice to produce ascitic fluid (ascites) in its abdomen; this fluid contains a high concentration of antibody.

An exemplary in vitro method involves the use of culture flasks. In this method, monoclonal antibodies can optionally be produced from the hybridoma using gas permeable bags or cell culture flasks.

Antibody Engineering in Phage Display Libraries:

PCT Application No. WO 94/18219, and its many US equivalents, including U.S. Pat. No. 6096551, all of which are hereby incorporated by reference as if fully set forth herein, describes methods for producing antibody libraries using universal or randomized immunoglobulin light chains, by using phage display libraries. The method involves inducing mutagenesis in a complementarity determining region (CDR) of an immunoglobulin light chain gene for the purpose of producing light chain gene libraries for use in combination with heavy chain genes and gene libraries to produce antibody libraries of diverse and novel immunospecificities. The method comprises amplifying a CDR portion of an immunoglobulin light chain gene by polymerase chain reaction (PCR) using a PCR primer oligonucleotide. The resultant gene portions are inserted into phagemids for production of a phage display library, wherein the engineered light chains are displayed by the phages, for example for testing their binding specificity.

Antibody fragments according to the present invention can be prepared by proteolytic hydrolysis of the antibody or by expression in *E. coli* or mammalian cells (e.g. Chinese hamster ovary cell culture or other protein expression systems) of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')2. This fragment can be further cleaved using a thiol reducing agent, and optionally a blocking group for the sulfhydryl groups resulting from cleavage of disulfide linkages, to produce 3.5S Fab' monovalent fragments. Alternatively, an enzymatic cleavage using pepsin produces two monovalent Fab' fragments and an Fc fragment directly. These methods are described, for example, by Goldenberg, U.S. Pat. Nos. 4,036,945 and 4,331,647, and references contained therein, which patents are hereby incorporated by reference in their entirety. See also Porter, R. R. [Biochem. J. 73: 119-126 (1959)]. Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

Fv fragments comprise an association of VH and VL chains. This association may be noncovalent, as described in Inbar et al. [Proc. Nat'l Acad. Sci. USA 69:2659-62 (19720]. Alternatively, the variable chains can be linked by an intermolecular disulfide bond or cross-linked by chemicals such as glutaraldehyde. Preferably, the Fv fragments comprise VH and VL chains connected by a peptide linker. These single-chain antigen binding proteins (sFv) are prepared by constructing a structural gene comprising DNA sequences encoding the VH and VL domains connected by an oligonucleotide. The structural gene is inserted into an expression vector, which is subsequently introduced into a host cell such as *E. coli*. The recombinant host cells synthesize a single polypeptide chain with a linker peptide bridging the two V domains. A scFv antibody fragment is an engineered antibody derivative that includes heavy- and light chain variable regions joined by a peptide linker. The minimal size of antibody molecules are those that still comprise the complete antigen binding site. ScFv antibody fragments are potentially more effective than unmodified IgG antibodies. The reduced size of 27-30 kDa permits them to penetrate tissues and solid tumors more readily. Methods for producing sFvs are described, for example, by [Whitlow and Filpula, Methods 2: 97-105 (1991); Bird et al., Science 242:423-426 (1988); Pack et al., Bio/Technology 11:1271-77 (1993); and U.S. Pat. No. 4,946,778, which is hereby incorporated by reference in its entirety.

Another form of an antibody fragment is a peptide coding for a single complementarity-determining region (CDR). CDR peptides ("minimal recognition units") can be obtained by constructing genes encoding the CDR of an antibody of interest. Such genes are prepared, for example, by using the polymerase chain reaction to synthesize the variable region from RNA of antibody-producing cells. See, for example, Larrick and Fry [Methods, 2: 106-10 (1991)]. Optionally, there may be 1, 2 or 3 CDRs of different chains, but preferably there are 3 CDRs of 1 chain. The chain could be the heavy or the light chain.

Humanized forms of non-human (e.g., murine) antibodies are chimeric molecules of immunoglobulins, immunoglobulin chains or fragments thereof (such as Fv, Fab, Fab', F(ab') or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., Nature, 321: 522-525 (1986); Riechmann et al., Nature, 332:323-329 (1988); and Presta, Curr. Op. Struct. Biol., 2:593-596 (1992)].

Methods for humanizing non-human antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and co-workers [Jones et al., Nature, 321:522-525 (1986); Riechmann et al., Nature 332:323-327 (1988); Verhoeyen et al., Science, 239:1534-1536 (1988)], by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991);

Marks et al., J. Mol. Biol., 222:581 (1991)]. The techniques of Cole et al. and Boerner et al. are also available for the preparation of human monoclonal antibodies (Cole et al., Monoclonal Antibodies and Cancer Therapy, Alan R. Liss, p. 77 (1985) and Boerner et al., J. Immunol., 147(1):86-95 (1991)]. Similarly, human antibodies can be made by introduction of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., Bio/Technology 10,: 779-783 (1992); Lonberg et al., Nature 368: 856-859 (1994); Morrison, Nature 368 812-13 (1994); Fishwild et al., Nature Biotechnology 14, 845-51 (1996); Neuberger, Nature Biotechnology 14: 826 (1996); and Lonberg and Huszar, Intern. Rev. Immunol. 13, 65-93 (1995).

Preferably, the antibody of this aspect of the present invention specifically binds at least one epitope of the polypeptide variants of the present invention. As used herein, the term "epitope" refers to any antigenic determinant on an antigen to which the paratope of an antibody binds.

Epitopic determinants usually consist of chemically active surface groupings of molecules such as amino acids or carbohydrate side chains and usually have specific three dimensional structural characteristics, as well as specific charge characteristics.

Optionally, a unique epitope may be created in a variant due to a change in one or more post-translational modifications, including but not limited to glycosylation and/or phosphorylation, as described below. Such a change may also cause a new epitope to be created, for example through removal of glycosylation at a particular site.

An epitope according to the present invention may also optionally comprise part or all of a unique sequence portion of a variant according to the present invention in combination with at least one other portion of the variant which is not contiguous to the unique sequence portion in the linear polypeptide itself, yet which are able to form an epitope in combination. One or more unique sequence portions may optionally combine with one or more other non-contiguous portions of the variant (including a portion which may have high homology to a portion of the known protein) to form an epitope.

Immunoassays:

In another embodiment of the present invention, an immunoassay can be used to qualitatively or quantitatively detect and analyze markers in a sample. This method comprises: providing an antibody that specifically binds to a marker; contacting a sample with the antibody; and detecting the presence of a complex of the antibody bound to the marker in the sample.

To prepare an antibody that specifically binds to a marker, purified protein markers can be used. Antibodies that specifically bind to a protein marker can be prepared using any suitable methods known in the art.

After the antibody is provided, a marker can be detected and/or quantified using any of a number of well recognized immunological binding assays. Useful assays include, for example, an enzyme immune assay (EIA) such as enzyme-linked immunosorbent assay (ELISA), a radioimmune assay (RIA), a Western blot assay, or a slot blot assay see, e.g., U.S. Pat. Nos. 4,366,241; 4,376,110; 4,517,288; and 4,837,168).

Generally, a sample obtained from a subject can be contacted with the antibody that specifically binds the marker.

Optionally, the antibody can be fixed to a solid support to facilitate washing and subsequent isolation of the complex, prior to contacting the antibody with a sample. Examples of solid supports include but are not limited to glass or plastic in the form of, e.g., a microtiter plate, a stick, a bead, or a microbead. Antibodies can also be attached to a solid support.

After incubating the sample with antibodies, the mixture is washed and the antibody-marker complex formed can be detected. This can be accomplished by incubating the washed mixture with a detection reagent. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

Throughout the assays, incubation and/or washing steps may be required after each combination of reagents. Incubation steps can vary from about 5 seconds to several hours, preferably from about 5 minutes to about 24 hours. However, the incubation time will depend upon the assay format, marker, volume of solution, concentrations and the like. Usually the assays will be carried out at ambient temperature, although they can be conducted over a range of temperatures, such as 10° C. to 40° C.

The immunoassay can be used to determine a test amount of a marker in a sample from a subject. First, a test amount of a marker in a sample can be detected using the immunoassay methods described above. If a marker is present in the sample, it will form an antibody-marker complex with an antibody that specifically binds the marker under suitable incubation conditions described above. The amount of an antibody-marker complex can optionally be determined by comparing to a standard. As noted above, the test amount of marker need not be measured in absolute units, as long as the unit of measurement can be compared to a control amount and/or signal.

Preferably used are antibodies which specifically interact with the polypeptides of the present invention and not with wild type proteins or other isoforms thereof, for example. Such antibodies are directed, for example, to the unique sequence portions of the polypeptide variants of the present invention, including but not limited to bridges, heads, tails and insertions described in greater detail below. Preferred embodiments of antibodies according to the present invention are described in greater detail with regard to the section entitled "Antibodies".

Radio-immunoassay (RIA): In one version, this method involves precipitation of the desired substrate and in the methods detailed hereinbelow, with a specific antibody and radiolabelled antibody binding protein (e.g., protein A labeled with $I^{125}$) immobilized on a precipitable carrier such as agarose beads. The number of counts in the precipitated pellet is proportional to the amount of substrate.

In an alternate version of the RIA, a labeled substrate and an unlabelled antibody binding protein are employed. A sample containing an unknown amount of substrate is added in varying amounts. The decrease in precipitated counts from the labeled substrate is proportional to the amount of substrate in the added sample.

Enzyme linked immunosorbent assay (ELISA): This method involves fixation of a sample (e.g., fixed cells or a proteinaceous solution) containing a protein substrate to a surface such as a well of a microtiter plate. A substrate specific antibody coupled to an enzyme is applied and allowed to bind to the substrate. Presence of the antibody is then detected and quantitated by a calorimetric reaction employing the enzyme coupled to the antibody. Enzymes commonly employed in this method include horseradish peroxidase and alkaline phosphatase. If well calibrated and within the linear range of response, the amount of substrate present in the sample is proportional to the amount of color produced. A substrate standard is generally employed to improve quantitative accuracy.

Western blot: This method involves separation of a substrate from other protein by means of an acrylamide gel followed by transfer of the substrate to a membrane (e.g., nylon or PVDF). Presence of the substrate is then detected by antibodies specific to the substrate, which are in turn detected by antibody binding reagents. Antibody binding reagents may be, for example, protein A, or other antibodies. Antibody binding reagents may be radiolabelled or enzyme linked as described hereinabove. Detection may be by autoradiography, colorimetric reaction or chemiluminescence. This method allows both quantitation of an amount of substrate and determination of its identity by a relative position on the membrane which is indicative of a migration distance in the acrylamide gel during electrophoresis.

Immunohistochemical analysis: This method involves detection of a substrate in situ in fixed cells by substrate specific antibodies. The substrate specific antibodies may be enzyme linked or linked to fluorophores. Detection is by microscopy and subjective evaluation. If enzyme linked antibodies are employed, a colorimetric reaction may be required.

Fluorescence activated cell sorting (FACS): This method involves detection of a substrate in situ in cells by substrate specific antibodies. The substrate specific antibodies are linked to fluorophores. Detection is by means of a cell sorting machine which reads the wavelength of light emitted from each cell as it passes through a light beam. This method may employ two or more antibodies simultaneously.

Radio-Imaging Methods:

These methods include but are not limited to, positron emission tomography (PET) and single photon emission computed tomography (SPECT). Both of these techniques are non-invasive, and can be used to detect and/or measure a wide variety of tissue events and/or functions, such as detecting cancerous cells for example. Unlike PET, SPECT can optionally be used with two labels simultaneously. SPECT has some other advantages as well, for example with regard to cost and the types of labels that can be used. For example, U.S. Pat. No. 6,696,686 describes the use of SPECT for detection of breast cancer, and is hereby incorporated by reference as if fully set forth herein. The importance of PET and SPECT, and other such imaging methods, and their uses for in vivo imaging of biomarkers, is also described with regard to the "Background" section given above.

Display Libraries:

According to still another aspect of the present invention there is provided a display library comprising a plurality of display vehicles (such as phages, viruses or bacteria) each displaying at least 6, at least 7, at least 8, at least 9, at least 10, 10-15, 12-17, 15-20, 15-30 or 20-50 consecutive amino acids derived from the polypeptide sequences of the present invention.

Methods of constructing such display libraries are well known in the art. Such methods are described in, for example, Young AC, et al., "The three-dimensional structures of a polysaccharide binding antibody to *Cryptococcus neoformans* and its complex with a peptide from a phage display library: implications for the identification of peptide mimotopes" J Mol Biol Dec. 12, 1997;274(4):622-34; Giebel L B et al. "Screening of cyclic peptide phage libraries identifies ligands that bind streptavidin with high affinities" Biochemistry Nov. 28, 1995;34(47):15430-5; Davies E L et al., "Selection of specific phage-display antibodies using libraries derived from chicken immunoglobulin genes" J Immunol Methods Oct. 12, 1995;186(1):125-35; Jones C R T al. "Current trends in molecular recognition and bioseparation" J Chromatogr A Jul. 14, 1995;707(1):3-22; Deng S J et al. "Basis for selection of improved carbohydrate-binding single-chain antibodies from synthetic gene libraries" Proc Natl Acad Sci U S A May 23, 1995;92(11):4992-6; and Deng S J et al. "Selection of antibody single-chain variable fragments with improved carbohydrate binding by phage display" J Biol Chem Apr. 1, 1994;269(13):9533-8, which are incorporated herein by reference.

Theranostics:

The term theranostics describes the use of diagnostic testing to diagnose the disease, choose the correct treatment regime according to the results of diagnostic testing and/or monitor the patient response to therapy according to the results of diagnostic testing. Theranostic tests can be used to select patients for treatments that are particularly likely to benefit them and unlikely to produce side-effects. They can also provide an early and objective indication of treatment efficacy in individual patients, so that (if necessary) the treatment can be altered with a minimum of delay. For example: DAKO and Genentech together created HercepTest and Herceptin (trastuzumab) for the treatment of breast cancer, the first theranostic test approved simultaneously with a new therapeutic drug. In addition to HercepTest (which is an immunohistochemical test), other theranostic tests are in development which use traditional clinical chemistry, immunoassay, cell-based technologies and nucleic acid tests. PPGx's recently launched TPMT (thiopurine S-methyltransferase) test, which is enabling doctors to identify patients at risk for potentially fatal adverse reactions to 6-mercaptopurine, an agent used in the treatment of leukemia. Also, Nova Molecular pioneered SNP genotyping of the apolipoprotein E gene to predict Alzheimer's disease patients' responses to cholinomimetic therapies and it is now widely used in clinical trials of new drugs for this indication. Thus, the field of theranostics represents the intersection of diagnostic testing information that predicts the response of a patient to a treatment with the selection of the appropriate treatment for that particular patient.

Surrogate Markers:

A surrogate marker is a marker, that is detectable in a laboratory and/or according to a physical sign or symptom on the patient, and that is used in therapeutic trials as a substitute for a clinically meaningful endpoint. The surrogate marker is a direct measure of how a patient feels, functions, or survives which is expected to predict the effect of the therapy. The need for surrogate markers mainly arises when such markers can be measured earlier, more conveniently, or more frequently than the endpoints of interest in terms of the effect of a treatment on a patient, which are referred to as the clinical endpoints. Ideally, a surrogate marker should be biologically plausible, predictive of disease progression and measurable by standardized assays (including but not limited to traditional clinical chemistry, immunoassay, cell-based technologies, nucleic acid tests and imaging modalities).

Surrogate endpoints were used first mainly in the cardiovascular area. For example, antihypertensive drugs have been approved based on their effectiveness in lowering blood pressure. Similarly, in the past, cholesterol-lowering agents have been approved based on their ability to decrease serum cholesterol, not on the direct evidence that they decrease mortality from atherosclerotic heart disease. The measurement of cholesterol levels is now an accepted surrogate marker of atherosclerosis. In addition, currently two commonly used surrogate markers in HIV studies are CD4+ T cell counts and quantitative plasma HIV RNA (viral load).

Monoclonal Antibody Therapy:

Monoclonal antibodies by identifying and binding to the target cells alert other cells in the immune system to the presence of the cancer cells. Monoclonal antibody therapy is a form of passive immunotherapy because the antibodies are made in large quantities outside the body (in the lab) rather than by a person's immune system.

Two types of monoclonal antibodies are used in cancer treatments:

1. Naked monoclonal antibodies. 2. Conjugated monoclonal antibodies—joined to a chemotherapy drug, radioactive particle, or a toxin (a substance that poisons cells).

1. Naked Monoclonal Antibodies:

Naked antibodies attach themselves to specific antigens on cancer cells. They can act in different ways: some mark the cancer cell for the immune system to destroy it, while others attach to receptors and block their ligand binding site and may therefore prevent the cancer cells from growing rapidly. Trastuzumab (Herceptin), a naked MAb used against advanced breast cancer, works in that way.

2. Conjugated Monoclonal Antibodies:

Conjugated monoclonal antibodies are joined to drugs, toxins, or radioactive atoms. They are used as delivery vehicles to take those substances directly to the cancer cells. The MAb acts as a homing device, circulating in the body until it finds a cancer cell with a matching antigen. It delivers the toxic substance to where it is needed most, minimizing damage to normal cells in other parts of the body. Conjugated MAbs are also sometimes referred to as "tagged," "labeled," or "loaded" antibodies. MAbs with chemotherapy drugs attached are generally referred to as chemolabeled. MAbs with radioactive particles attached are referred to as radiolabeled, and this type of therapy is known as radioimmunotherapy (RIT). MAbs attached to toxins are called immunotoxins.

An illustrative, non-limiting example is provided herein of a method of treatment of a patient with an antibody to a variant as described herein, such that the variant is a target of the antibody. A patient with breast cancer is treated with a radiolabeled humanized antibody against an appropriate breast cancer target as described herein. The patient is optionally treated with a dosage of labeled antibody ranging from 10 to 30 mCi. Of course any type of therapeutic label may optionally be used.

The following sections relate to Candidate Marker Examples. It should be noted that Table numbering is restarted within each Example, which starts with the words "Description for Cluster".

CANDIDATE MARKER EXAMPLES SECTION

This Section relates to Examples of sequences according to the present invention, including illustrative methods of selection thereof with regard to cancer; other markers were selected as described below for the individual markers.

Description of the methodology undertaken to uncover the biomolecular sequences of the present invention.

Human ESTs and cDNAs were obtained from GenBank versions 136 (Jun. 15, 2003 ftp.ncbi.nih.gov/genbank/release.notes/gb136.release.notes); NCBI genome assembly of April 2003; RefSeq sequences from June 2003; Genbank version 139 (December 2003); Human Genome from NCBI (Build 34) (from October 2003); and RefSeq sequences from December 2003. With regard to GenBank sequences, the human EST sequences from the EST (GBEST) section and the human mRNA sequences from the primate (GBPRI) section were used; also the human nucleotide RefSeq mRNA sequences were used (see for example .ncbi.nlm.nih. gov/Genbank/GenbankOverview.html and for a reference to the EST section, see .ncbi.nlm.nih.gov/dbEST/; a general reference to dbEST, the EST database in GenBank, may be found in Boguski et al, Nat Genet. 1993 August; 4(4):332-3; all of which are hereby incorporated by reference as if fully set forth herein).

Novel splice variants were predicted using the LEADS clustering and assembly system as described in Sorek, R., Ast, G. & Graur, D. Alu-containing exons are alternatively spliced. Genome Res 12, 1060-7 (2002); U.S. Pat. No: 6,625,545; and U.S. patent application Ser. No. 10/426,002, published as US20040101876 on May 27 2004; all of which are hereby incorporated by reference as if fully set forth herein. Briefly, the software cleans the expressed sequences from repeats, vectors and immunoglobulins. It then aligns the expressed sequences to the genome taking alternatively splicing into account and clusters overlapping expressed sequences into "clusters" that represent genes or partial genes.

These were annotated using the GeneCarta (Compugen, Tel-Aviv, Israel) platform. The GeneCarta platform includes a rich pool of annotations, sequence information (particularly of spliced sequences), chromosomal information, alignments, and additional information such as SNPs, gene ontology terms, expression profiles, functional analyses, detailed domain structures, known and predicted proteins and detailed homology reports.

A brief explanation is provided with regard to the method of selecting the candidates. However, it should be noted that this explanation is provided for descriptive purposes only, and is not intended to be limiting in any way. The potential markers were identified by a computational process that was designed to find genes and/or their splice variants that are specifically expressed in cancer, as opposed to normal tissues, by using databases of expressed sequences. Various parameters related to the information in the EST libraries, determined according to classification by library annotation, were used to assist in locating genes and/or splice variants thereof that are specifically and/or differentially expressed in cancer. The detailed description of the selection method and of these parameters is presented in Example 1 below.

Example 1

Selecting Candidates with Regard to Cancer

Example 1.1

Cancer Markers

A brief explanation is provided with regard to a non-limiting method of selecting the candidates for cancer diagnostics. However, it should be noted that this explanation is provided for descriptive purposes only, and is not intended to be limiting in any way. The potential markers were identified by a computational process that was designed to find genes and/ or their splice variants that are over-expressed in tumor tissues, by using databases of expressed sequences. Various parameters related to the information in the EST libraries, determined according to a manual classification process, were used to assist in locating genes and/or splice variants thereof that are over-expressed in cancerous tissues. The detailed description of the selection method is presented in Example 1 below. The cancer biomarkers selection engine and the following wet validation stages are schematically summarized in FIG. 1.

Example 1.2

Identification of Differentially Expressed Gene Products—Algorithm

In order to distinguish between differentially expressed gene products and constitutively expressed genes (i.e., house keeping genes) an algorithm based on an analysis of frequencies was configured. A specific algorithm for identification of transcripts over expressed in cancer is described hereinbelow.

Dry Analysis

Library annotation—EST libraries are manually classified according to:
  (i) Tissue origin
  (ii) Biological source—Examples of frequently used biological sources for construction of EST libraries include cancer cell-lines; normal tissues; cancer tissues; fetal tissues; and others such as normal cell lines and pools of normal cell-lines, cancer cell-lines and combinations thereof. A specific description of abbreviations used below with regard to these tissues/cell lines etc is given above.
  (iii) Protocol of library construction—various methods are known in the art for library construction including normalized library construction; non-normalized library construction; subtracted libraries; ORESTES and others. It will be appreciated that at times the protocol of library construction is not indicated.

The following rules are followed:

EST libraries originating from identical biological samples are considered as a single library.

EST libraries which include above-average levels of DNA contamination are eliminated.

Dry computation—development of engines which are capable of identifying genes and splice variants that are temporally and spacially expressed.

Clusters (genes) having at least five sequences including at least two sequences from the tissue of interest are analyzed.

Example 1.3

Identification of Genes Over Expressed in Cancer

Two different scoring algorithms were developed.

Libraries score—candidate sequences which are supported by a number of cancer libraries, are more likely to serve as specific and effective diagnostic markers.

The basic algorithm—for each cluster the number of cancer and normal libraries contributing sequences to the cluster was counted. Fisher exact test was used to check if cancer libraries are significantly over-represented in the cluster as compared to the total number of cancer and normal libraries.

Library counting: Small libraries (e.g., less than 1000 sequences) were excluded from consideration unless they participate in the cluster. For this reason, the total number of libraries is actually adjusted for each cluster.

Clones no. score—Generally, when the number of ESTs is much higher in the cancer libraries relative to the normal libraries it might indicate actual over-expression.

The algorithm—

Clone counting: For counting EST clones each library protocol class was given a weight based on our belief of how much the protocol reflects actual expression levels:
  (i) non-normalized: 1
  (ii) normalized: 0.2
  (iii) all other classes: 0.1

Clones number score—The total weighted number of EST clones from cancer libraries was compared to the EST clones from normal libraries. To avoid cases where one library contributes to the majority of the score, the contribution of the library that gives most clones for a given cluster was limited to 2 clones.

The score was computed as $$\frac{c+1}{C} \bigg/ \frac{n+1}{N}$$

where:
  c—weighted number of "cancer" clones in the cluster.
  C—weighted number of clones in all "cancer" libraries.
  n—weighted number of "normal" clones in the cluster.
  N—weighted number of clones in all "normal" libraries.

Clones number score significance—Fisher exact test was used to check if EST clones from cancer libraries are significantly over-represented in the cluster as compared to the total number of EST clones from cancer and normal libraries.

Two search approaches were used to find either general cancer-specific candidates or tumor specific candidates.
  Libraries/sequences originating from tumor tissues are counted as well as libraries originating from cancer cell-lines ("normal" cell-lines were ignored).
  Only libraries/sequences originating from tumor tissues are counted Example 1.4

Identification of Tissue Specific Genes

For detection of tissue specific clusters, tissue libraries/sequences were compared to the total number of libraries/sequences in cluster. Similar statistical tools to those described in above were employed to identify tissue specific genes. Tissue abbreviations are the same as for cancerous tissues, but are indicated with the header "normal tissue".

The algorithm—for each tested tissue T and for each tested cluster the following were examined:

1. Each cluster includes at least 2 libraries from the tissue T. At least 3 clones (weighed—as described above) from tissue T in the cluster; and
2. Clones from the tissue T are at least 40% from all the clones participating in the tested cluster Fisher exact test P-values were computed both for library and weighted clone counts to check that the counts are statistically significant.

Example 1.5

Identification of Splice Variants Over Expressed in Cancer of Clusters Which Are Not Over Expressed in Cancer Cancer-specific splice variants containing a unique region were identified.

Identification of unique sequence regions in splice variants

A Region is defined as a group of adjacent exons that always appear or do not appear together in each splice variant.

A "segment" (sometimes referred also as "seg" or "node") is defined as the shortest contiguous transcribed region without known splicing inside.

Only reliable ESTs were considered for region and segment analysis. An EST was defined as unreliable if:

(i) Unspliced;
(ii) Not covered by RNA;
(iii) Not covered by spliced ESTs; and
(iv) Alignment to the genome ends in proximity of long poly-A stretch or starts in proximity of long poly-T stretch.

Only reliable regions were selected for further scoring. Unique sequence regions were considered reliable if:

(i) Aligned to the genome; and
(ii) Regions supported by more than 2 ESTs.

The Algorithm

Each unique sequence region divides the set of transcripts into 2 groups:

(i) Transcripts containing this region (group TA).
(ii) Transcripts not containing this region (group TB).

The set of EST clones of every cluster is divided into 3 groups:

(i) Supporting (originating from) transcripts of group TA (S1).
(ii) Supporting transcripts of group TB (S2).
(iii) Supporting transcripts from both groups (S3).

Library and clones number scores described above were given to S1 group.

Fisher Exact Test P-values were used to check if:

S1 is significantly enriched by cancer EST clones compared to S2; and

S1 is significantly enriched by cancer EST clones compared to cluster background (S1+S2+S3).

Figure 2:
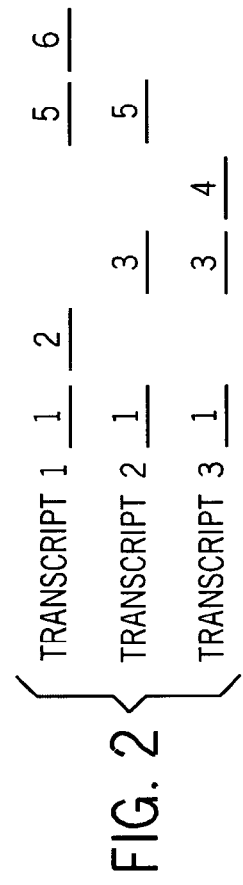
FIG. 2 Schematic illustration, depicting grouping of transcripts of a given cluster based on presence or absence of unique sequence regions.

Identification of unique sequence regions and division of the group of transcripts accordingly is illustrated in FIG. 2. Each of these unique sequence regions corresponds to a segment, also termed herein a "node".

Region 1: common to all transcripts, thus it is not considered; Region 2: specific to Transcript 1: T__1 unique regions (2+6) against T__2+3 unique regions (3+4); Region 3: specific to Trancripts 2+3: T__2+3 unique regions (3+4) against T1 unique regions (2+6); Region 4: specific to Transcript 3: T__3 unique regions (4) against T1+2 unique regions (2+5+6); Region 5: specific to Transcript 1+2: T__1+2 unique regions (2+5+6) against T3 unique regions (4); Region 6: specific to Transcript 1: same as region 2.

Example 1.6

Identification of Cancer Specific Splice Variants of Genes Over Expressed in Cancer A search for EST supported (no mRNA) regions for genes of:

(i) known cancer markers
(ii) Genes shown to be over-expressed in cancer in published micro-array experiments.

Reliable EST supported-regions were defined as supported by minimum of one of the following:

(i) 3 spliced ESTs; or
(ii) 2 spliced ESTs from 2 libraries;
(iii) 10 unspliced ESTs from 2 libraries, or
(iv) 3 libraries.

Example 2

Oligonucleotide-Based Micro-Array Experiment Protocol-Microarray Fabrication

Microarrays (chips) were printed by pin deposition using the MicroGrid II MGII 600 robot from BioRobotics Limited (Cambridge, UK). 50-mer oligonucleotides target sequences were designed by Compugen Ltd (Tel-Aviv, IL) as described by A. Shoshan et al, "Optical technologies and informatics", Proceedings of SPIE. Vol 4266, pp. 86-95 (2001). The designed oligonucleotides were synthesized and purified by desalting with the Sigma-Genosys system (The Woodlands, Tex., US) and all of the oligonucleotides were joined to a C6 amino-modified linker at the 5' end, or being attached directly to CodeLink slides (Cat #25-6700-01. Amersham Bioscience, Piscataway, N.J., US). The 50-mer oligonucleotides, forming the target sequences, were first suspended in Ultrapure DDW (Cat #01-866-1A Kibbutz Beit-Haemek, Israel) to a concentration of 50 μM. Before printing the slides, the oligonucleotides were resuspended in 300 mM sodium phosphate (pH 8.5) to final concentration of 150 mM and printed at 35-40% relative humidity at 21° C.

Each slide contained a total of 9792 features in 32 subarrays. Of these features, 4224 features were sequences of interest according to the present invention and negative controls that were printed in duplicate. An additional 288 features (96 target sequences printed in triplicate) contained housekeeping genes from Human Evaluation Library2, Compugen Ltd, Israel. Another 384 features are E.coli spikes 1-6, which are oligos to E-Coli genes which are commercially available in the Array Control product (Array control-sense oligo spots, Ambion Inc. Austin, Tex. Cat #1781, Lot #112K06).

Post-Coupling Processing of Printed Slides

After the spotting of the oligonucleotides to the glass (CodeLink) slides, the slides were incubated for 24 hours in a sealed saturated NaCl humidification chamber (relative humidity 70-75%).

Slides were treated for blocking of the residual reactive groups by incubating them in blocking solution at 50° C. for 15 minutes (10 ml/slide of buffer containing 0.1M Tris, 50 mM ethanolamine, 0.1% SDS). The slides were then rinsed twice with Ultra-pure DDW (double distilled water). The slides were then washed with wash solution (10 ml/slide. 4×SSC, 0.1% SDS)) at 50° C. for 30 minutes on the shaker. The slides were then rinsed twice with Ultra-pure DDW, followed by drying by centrifugation for 3 minutes at 800 rpm.

Next, in order to assist in automatic operation of the hybridization protocol, the slides were treated with Ventana Discovery hybridization station barcode adhesives. The printed slides were loaded on a Bio-Optica (Milan, Italy) hematology staining device and were incubated for 10 minutes in 50 ml of 3-Aminopropyl Triethoxysilane (Sigma A3648 lot #122K589). Excess fluid was dried and slides were then incubated for three hours in 20 mm/Hg in a dark vacuum desiccator (Pelco 2251, Ted Pella, Inc. Redding Calif.).

The following protocol was then followed with the Genisphere 900-RP (random primer), with mini elute columns on the Ventana Discovery HybStation™, to perform the microarray experiments. Briefly, the protocol was performed as described with regard to the instructions and information provided with the device itself. The protocol included cDNA synthesis and labeling. cDNA concentration was measured with the TBS-380 (Turner Biosystems. Sunnyvale, Calif.) PicoFlour, which is used with the OliGreen ssDNA Quantitation reagent and kit. Hybridization was performed with the Ventana Hybridization device, according to the provided protocols (Discovery Hybridization Station Tuscon Ariz.).

The slides were then scanned with GenePix 4000B dual laser scanner from Axon Instruments Inc, and analyzed by GenePix Pro 5.0 software.

Figure 3:
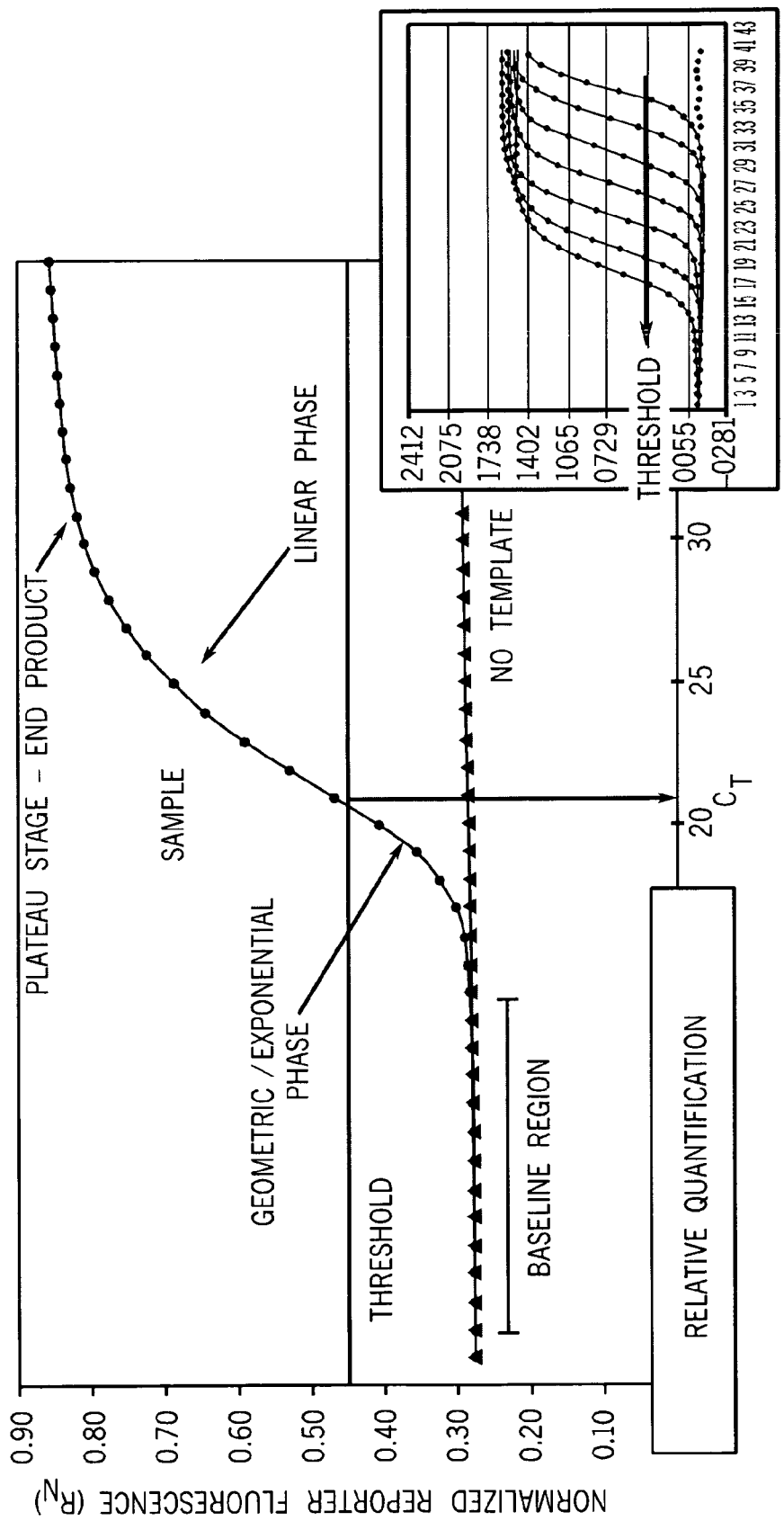
FIG. 3 is schematic summary of quantitative real-time PCR analysis.
Figure 4:
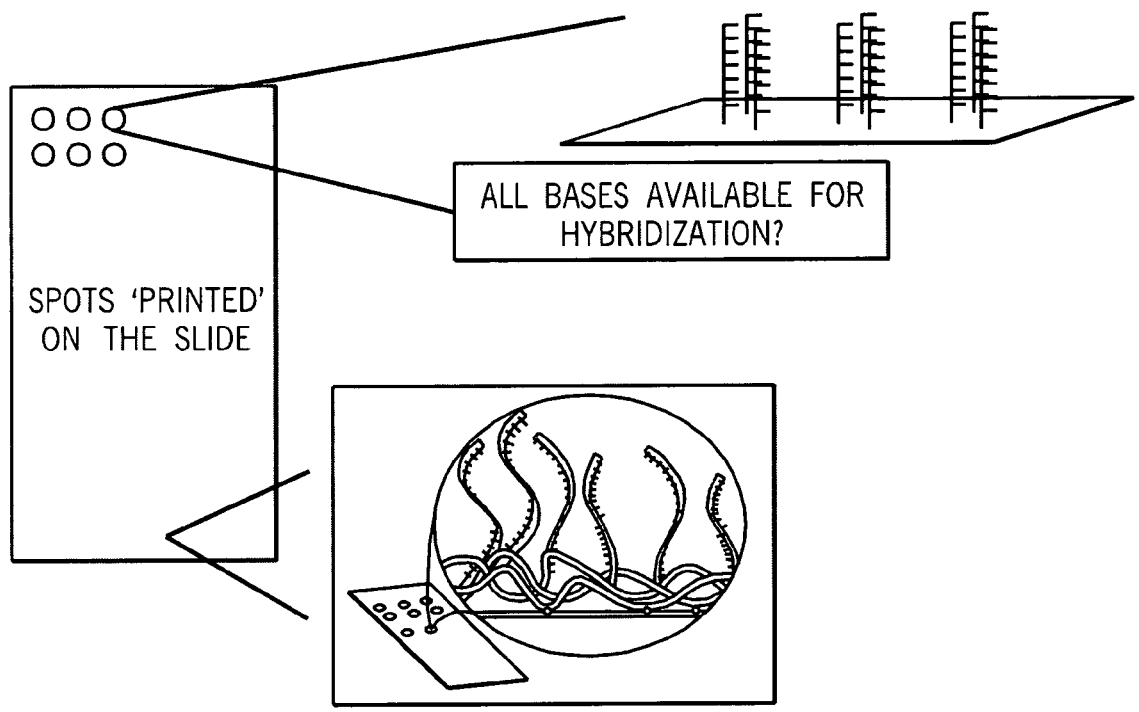
FIG. 4 is schematic presentation of the oligonucleotide based microarray fabrication.

Schematic summary of the oligonucleotide based microarray fabrication and the experimental flow is presented in FIGS. 3 and 4.

Briefly, as shown in FIG. 3, DNA oligonucleotides at 25 uM were deposited (printed) onto Amersham 'CodeLink' glass slides generating a well defined 'spot'. These slides are covered with a long-chain, hydrophilic polymer chemistry that creates an active 3-D surface that covalently binds the DNA oligonucleotides 5'-end via the C6-amine modification. This binding ensures that the full length of the DNA oligonucleotides is available for hybridization to the cDNA and also allows lower background, high sensitivity and reproducibility.

FIG. 4 shows a schematic method for performing the microarray experiments. It should be noted that stages on the left-hand or right-hand side may optionally be performed in any order, including in parallel, until stage 4 (hybridization). Briefly, on the left-hand side, the target oligonucleotides are being spotted on a glass microscope slide (although optionally other materials could be used) to form a spotted slide (stage 1). On the right hand side, control sample RNA and cancer sample RNA are Cy3 and Cy5 labeled, respectively (stage 2), to form labeled probes. It should be noted that the control and cancer samples come from corresponding tissues (for example, normal prostate tissue and cancerous prostate tissue). Furthermore, the tissue from which the RNA was taken is indicated below in the specific examples of data for particular clusters, with regard to overexpression of an oligonucleotide from a "chip" (microarray), as for example "prostate" for chips in which prostate cancerous tissue and normal tissue were tested as described above. In stage 3, the probes are mixed. In stage 4, hybridization is performed to form a processed slide. In stage 5, the slide is washed and scanned to form an image file, followed by data analysis in stage 6.

Diseases and conditions that may be diagnosed with one or more variant(s) according to the present invention Ovarian Cancer Certain splice variants described herein are potential markers for ovarian cancer. Ovarian cancer markers according to the present invention which may also optionally have this utility include but are not limited to: HSU40434 variants, R11723 variants, T27396 variants and HSUPARAA variants.

Other conditions that may be diagnosed by these markers or variants of them include but are not limited to the presence, risk and/or extent of the following:

1. The identification of a metastasis of unknown origin which originated from a primary ovarian cancer, for example gastric carcinoma (such as Krukenberg tumor), breast cancer, colorectal carcinoma and pancreatic carcinoma.
2. As a marker to distinguish between different types of ovarian cancer, therefore potentially affect treatment choice (e.g. discrimination between epithelial tumors and germ cell tumors).
3. As a tool in the assessment of abdominal mass and in particular in the differential diagnosis between a benign and malignant ovarian cysts.
4. As a tool for the assessment of infertility.
5. Other conditions that may elevate serum levels of ovary related markers. These include but are not limited to: cancers of the endometrium, cervix, fallopian tubes, pancreas, breast, lung and colon; nonmalignant conditions such as pregnancy, endometriosis, pelvic inflammatory disease and uterine fibroids.
6. Conditions which have similar symptoms, signs and complications as ovarian cancer and where the differential diagnosis between them and ovarian cancer is of clinical importance including but not limited to:
   a. Non-malignant causes of pelvic mass. Including, but not limited to: benign (functional) ovarian cyst, uterine fibroids, endometriosis, benign ovarian neoplasms and inflammatory bowel lesions
   b. Any condition suggestive of a malignant tumor including but not limited to anorexia, cachexia, weight loss, fever, hypercalcemia, skeletal or abdominal pain, paraneoplastic syndrome.
   c. Ascites.

Lung Cancer

Certain splice variants described herein are potential markers for lung cancer. Lung cancer markers according to the present invention which may also optionally have this utility include but are not limited to: HSI6REC variants, HSU40434 variants, M62246 variants, M78076 variants and HSUPARAA variants. Other conditions that may be diagnosed by these markers or variants of them include but are not limited to the presence, risk and/or extent of the following:

1. The identification of a metastasis of unknown origin which originated from a primary lung cancer.
2. The assessment of a malignant tissue residing in the lung and is from a non-lung origin, including, but not limited to: osteogenic and soft tissue sarcomas; colorectal, uterine, cervix and corpus tumors; head and neck, breast, testis and salivary gland cancers; melanoma; and bladder and kidney tumors.
3. As a marker to distinguish between different types of lung cancer, therefore potentially affect treatment choice (e.g. small cell vs. non small cell tumors).
4. As a tool in the assessment of unexplained dyspnea and/or chronic cough and/or hemoptysis.
5. As a tool in the differential diagnosis of the origin of a pleural effusion.
6. Conditions which have similar symptoms, signs and complications as lung cancer and where the differential diagnosis between them and lung cancer is of clinical importance including but not limited to:
   a. Non-malignant causes of lung symptoms and signs. Symptoms and signs include, but are not limited to: lung lesions and infiltrates, wheeze, stridor.
   b. Other symptoms, signs and complications suggestive of lung cancer, such as tracheal obstruction, esophageal compression, dysphagia, recurrent laryngeal nerve paralysis, hoarseness, phrenic nerve paralysis with elevation of the hemidiaphragm and Homer syndrome.
   c. Any condition suggestive of a malignant tumor including but not limited to anorexia, cachexia, weight loss, fever, hypercalcemia, hypophosphatemia, hyponatremia, syndrome of inappropriate secretion of antidiuretic hormone, elevated ANP, elevated ACTH, hypokalemia, clubbing, neurologic-myopathic syndromes and thrombophlebitis.

Breast Cancer

Certain splice variants described herein are potential markers for breast cancer. Breast cancer markers according to the present invention which may also optionally have this utility include but are not limited to: R11723 variants, T27396 variants and HSUPARAA variants. Other conditions that may be diagnosed by these markers or variants of them include but are not limited to the presence, risk and/or extent of the following:
1. The identification of a metastasis of unknown origin which originated from a primary breast cancer tumor.
2. In the assessment of lymphadenopathy, and in particular axillary lymphadenopathy.
3. As a marker to distinguish between different types of breast cancer, therefore potentially affect treatment choice (e.g. as HER-2)
4. As a tool in the assessment of palpable breast mass and in particular in the differential diagnosis between a benign and malignant breast mass.
5. As a tool in the assessment of conditions affecting breast skin (e.g. Paget's disease) and their differentiation from breast cancer.
6. As a tool in the assessment of breast pain or discomfort resulting from either breast cancer or other possible conditions (e.g. Mastitis, Mondors syndrome).
7. Other conditions not mentioned above which have similar symptoms, signs and complications as breast cancer and where the differential diagnosis between them and breast cancer is of clinical importance including but not limited to:
   a. Abnormal mammogram and/or nipple retraction and/or nipple discharge due to causes other than breast cancer. Such causes include but are not limited to benign breast masses, melanoma, trauma and technical and/or anatomical variations.
   b. Any condition suggestive of a malignant tumor including but not limited to anorexia, cachexia, weight loss, fever, hypercalcemia, paraneoplastic syndrome.

Lymphadenopathy, weight loss and other signs and symptoms associated with breast cancer but originate from diseases different from breast cancer including but not limited to other malignancies, infections and autoimmune diseases.

Colon Cancer

Certain splice variants described herein are potential markers for colon cancer. Colon cancer markers according to the present invention which may also optionally have this utility include but are not limited to: HSI6REC variants, R11723 variants and T51958 variants. Diagnosis of colon cancer and or of other conditions that may be diagnosed by these markers or variants of them include but are not limited to the presence, risk and/or extent of the following:
1. Early diagnosis, staging, grading, prognosis, monitoring, and treatment of diseases associated with colon cancer, or to indicate a predisposition to such for preventative measures.
2. Determining whether colon cancer has metastasized and for monitoring the progress of colon cancer in a human which has not metastasized for the onset of metastasis.
3. Distinguishing between different types of colon cancer, such as adenocarcinoma (mucinous or signet ring cell originating); leiomyocarcomas; carcinoid and others.
4. Distinguishing between colon cancer and non-cancerous polyps.
5. Distinguishing between colon cancer and non-cancerous states.
6. Prediction of patient's drug response
7. As surrogate markers for clinical outcome of a treated cancer.

Related Disease Markers and Risk Factors for Detection by Biomarkers

In addition to the general clinical factors described above, as well as specific diagnostic aspects of each biomarker described below, there are field-specific disease markers/risk factors which may optionally relate to or present diagnostic applications for biomarkers according to the present invention. These field specific factors, as described below, relate to detection of ovarian cancer (or risk factors thereof) which may also serve as diagnostic markers.

Ovarian Cancer

Known ovarian cancer markers may be used for a variety of diagnoses and/or detection of risk factors, in addition to those related to ovarian cancer itself. These known markers include but are not limited to CA 125. CA 125 may optionally be used for a number of diagnostic assays, such as detection of sepsis (and/or similar bacterial infections) and/or monitoring of the course of infection (as described with regard to PCT Application No. WO 03/048776, hereby incorporated by reference as if fully set forth herein) for example.

Ovarian cancer markers according to the present invention which may also optionally have this utility include but are not limited to: cluster HSU40434 variants, cluster R11723 variants, cluster T27396 variants and cluster HSUPARAA variants.

Methods of Treatment:

As mentioned hereinabove the novel therapeutic protein variants of the present invention and compositions derived therefrom (i.e., peptides, oligonucleotides) can be used to treat cluster-related diseases.

Thus, according to an additional aspect of the present invention there is provided a method of treating cluster-related disease in a subject.

The subject according to the present invention is a mammal, preferably a human which has at least one type of the cluster-related diseases described hereinabove.

As mentioned hereinabove, the biomolecular sequences of the present invention can be used to treat subjects with the above-described diseases.

The subject according to the present invention is a mammal, preferably a human which is diagnosed with one of the diseases described hereinabove, or alternatively is predisposed to having one of the diseases described hereinabove.

As used herein the term "treating" refers to preventing, curing, reversing, attenuating, alleviating, minimizing, suppressing or halting the deleterious effects of the above-described diseases.

Treating, according to the present invention, can be effected by specifically upregulating or alternatively downregulating the expression of at least one of the polypeptides of the present invention in the subject.

Optionally, upregulation may be effected by administering to the subject at least one of the polypeptides of the present invention (e.g., recombinant or synthetic) or an active portion thereof, as described herein. However, since the bioavailability of large polypeptides may potentially be relatively small due to high degradation rate and low penetration rate, administration of polypeptides is preferably confined to small peptide fragments (e.g., about 100 amino acids). The polypeptide or peptide may optionally be administered in a pharmaceutical composition, described in more detail below.

It will be appreciated that treatment of the above-described diseases according to the present invention may be combined with other treatment methods known in the art (i.e., combination therapy). Thus, treatment of malignancies using the agents of the present invention may be combined with, for example, radiation therapy, antibody therapy and/or chemotherapy.

Alternatively or additionally, an upregulating method may optionally be effected by specifically upregulating the amount (optionally expression) in the subject of at least one of the polypeptides of the present invention or active portions thereof.

As is mentioned hereinabove and in the Examples section which follows, the biomolecular sequences of this aspect of the present invention may be used as valuable therapeutic tools in the treatment of diseases in which altered activity or expression of the wild-type gene product is known to contribute to disease onset or progression. For example in case a disease is caused by overexpression of a membrane bound receptor, a soluble variant thereof may be used as an antagonist which competes with the receptor for binding the ligand, to thereby terminate signaling from the receptor.

Examples of such diseases are listed in the Examples section which follows.

It will be appreciated that the polypeptides of the present invention may also have agonistic properties. These include increasing the stability of the ligand (e.g., IL-4), protection from proteolysis and modification of the pharmacokinetic properties of the ligand (i.e., increasing the half-life of the ligand, while decreasing the clearance thereof). As such, the biomolecular sequences of this aspect of the present invention may be used to treat conditions or diseases in which the wild-type gene product plays a favorable role, for example, increasing angiogenesis in cases of diabetes or ischemia.

Upregulating expression of the therapeutic protein variants of the present invention may be effected via the administration of at least one of the exogenous polynucleotide sequences of the present invention, ligated into a nucleic acid expression construct designed for expression of coding sequences in eukaryotic cells (e.g., mammalian cells), as described above. Accordingly, the exogenous polynucleotide sequence may be a DNA or RNA sequence encoding the variants of the present invention or active portions thereof.

It will be appreciated that the nucleic acid construct can be administered to the individual employing any suitable mode of administration, described hereinbelow (i.e., in-vivo gene therapy). Alternatively, the nucleic acid construct is introduced into a suitable cell via an appropriate gene delivery vehicle/method (transfection, transduction, homologous recombination, etc.) and an expression system as needed and then the modified cells are expanded in culture and returned to the individual (i.e., ex-vivo gene therapy). Nucleic acid constructs are described in greater detail above.

It will be appreciated that the present methodology may also be effected by specifically upregulating the expression of the variants of the present invention endogenously in the subject. Agents for upregulating endogenous expression of specific splice variants of a given gene include antisense oligonucleotides, which are directed at splice sites of interest, thereby altering the splicing pattern of the gene. This approach has been successfully used for shifting the balance of expression of the two isoforms of Bcl-x [Taylor (1999) Nat. Biotechnol. 17:1097-1100; and Mercatante (2001) J. Biol. Chem. 276:16411-16417]; IL-5R [Karras (2000) Mol. Pharmacol. 58:380-387]; and c-myc [Giles (1999) Antisense Acid Drug Dev. 9:213-220].

For example, interleukin 5 and its receptor play a critical role as regulators of hematopoiesis and as mediators in some inflammatory diseases such as allergy and asthma. Two alternatively spliced isoforms are generated from the IL-5R gene, which include (i.e., long form) or exclude (i.e., short form) exon 9. The long form encodes for the intact membrane-bound receptor, while the shorter form encodes for a secreted soluble non-functional receptor. Using 2'-O-MOE-oligonucleotides specific to regions of exon 9, Karras and co-workers (supra) were able to significantly decrease the expression of the wild type receptor and increase the expression of the shorter isoforms. Design and synthesis of oligonucleotides which can be used according to the present invention are described hereinbelow and by Sazani and Kole (2003) Progress in Moleclular and Subcellular Biology 31:217-239.

Upregulating expression of the polypeptides of the present invention in a subject may be effected via the administration of at least one of the exogenous polynucleotide sequences of the present invention ligated into a nucleic acid expression construct designed for expression of coding sequences in eukaryotic cells (e.g., mammalian cells). Accordingly, the exogenous polynucleotide sequence may be a DNA or RNA sequence encoding the variants of the present invention or active portions thereof.

It will be appreciated that the nucleic acid construct can be administered to the individual employing any suitable mode of administration, described hereinbelow (i.e., in-vivo gene therapy). Alternatively, the nucleic acid construct is introduced into a suitable cell via an appropriate gene delivery vehicle/method (transfection, transduction, homologous recombination, etc.) and an expression system as needed and then the modified cells are expanded in culture and returned to the individual (i.e., ex-vivo gene therapy).

Preferably, the promoter utilized by the nucleic acid construct of the present invention is active in the specific cell population transformed. Examples of cell type-specific and/or tissue-specific promoters include promoters, such as albumin that is liver specific [Pinkert et al., (1987) Genes Dev. 1:268-277], lymphoid specific promoters [Calame et al., (1988) Adv. Immunol. 43:235-275]; in particular promoters of T-cell receptors [Winoto et al., (1989) EMBO J. 8:729-733] and immunoglobulins; [Banerji et al. (1983) Cell 33729-740], neuron-specific promoters such as the neurofilament promoter [Byrne et al. (1989) Proc. Natl. Acad. Sci. USA 86:5473-5477], pancreas-specific promoters [Edlunch et al. (1985) Science 230:912-916] or mammary gland-specific promoters such as the milk whey promoter (U.S. Pat. No. 4,873,316 and European Patent Application No. EP 264,166).

Examples of suitable constructs include, but are not limited to, pcDNA3, pcDNA3.1 (+/−), pGL3, PzeoSV2 (+/−), pDisplay, pEF/myc/cyto, pCMV/myc/cyto each of which is commercially available from Invitrogen Co. (www.invitrogen.com). Examples of retroviral vector and packaging systems are those sold by Clontech, San Diego, Calif., including Retro-X vectors pLNCX and pLXSN, which permit cloning into multiple cloning sites and the trasgene is transcribed from CMV promoter. Vectors derived from Mo-MuLV are also included such as pBabe, where the transgene will be transcribed from the 5'LTR promoter.

Currently preferred in vivo nucleic acid transfer techniques include transfection with viral or non-viral constructs, such as adenovirus, lentivirus, Herpes simplex I virus, or adeno-associated virus (AAV) and lipid-based systems. Useful lipids for lipid-mediated transfer of the gene are, for example, DOTMA, DOPE, and DC-Chol [Tonkinson et al., Cancer Investigation, 14(1): 54-65 (1996)]. The most preferred constructs for use in gene therapy are viruses, most preferably adenoviruses, AAV, lentiviruses, or retroviruses. A viral construct such as a retroviral construct includes at least one transcriptional promoter/enhancer or locus-defining element(s), or other elements that control gene expression by other means such as alternate splicing, nuclear RNA export, or post-translational modification of messenger. Such vector constructs also include a packaging signal, long terminal repeats (LTRs) or portions thereof, and positive and negative strand primer binding sites appropriate to the virus used, unless it is already present in the viral construct. In addition, such a construct typically includes a signal sequence for secretion of the peptide from a host cell in which it is placed. Preferably the signal sequence for this purpose is a mammalian signal sequence or the signal sequence of the polypeptide variants of the present invention. Optionally, the construct may also include a signal that directs polyadenylation, as well as one or more restriction sites and a translation termination sequence. By way of example, such constructs will typically include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

It will be appreciated that the present methodology may also be performed by specifically upregulating the expression of the splice variants of the present invention endogenously in the subject. Agents for upregulating endogenous expression of specific splice variants of a given gene include antisense oligonucleotides, which are directed at splice sites of interest, thereby altering the splicing pattern of the gene. This approach has been successfully used for shifting the balance of expression of the two isoforms of Bcl-x [Taylor (1999) Nat. Biotechnol. 17:1097-1100; and Mercatante (2001) J. Biol. Chem. 276:16411-16417]; IL-5R [Karras (2000) Mol. Pharmacol. 58:380-387]; and c-myc [Giles (1999) Antisense Acid Drug Dev. 9:213-220].

For example, interleukin 5 and its receptor play a critical role as regulators of hematopoiesis and as mediators in some inflammatory diseases such as allergy and asthma. Two alternatively spliced isoforms are generated from the IL-5R gene, which include (i.e., long form) or exclude (i.e., short form) exon 9. The long form encodes for the intact membrane-bound receptor, while the shorter form encodes for a secreted soluble non-functional receptor. Using 2'-O-MOE-oligonucleotides specific to regions of exon 9, Karras and co-workers (supra) were able to significantly decrease the expression of the wild type receptor and increase the expression of the shorter isoforms. Design and synthesis of oligonucleotides which can be used according to the present invention are described hereinbelow and by Sazani and Kole (2003) Progress in Moleclular and Subcellular Biology 31:217-239.

Treatment can preferably effected by agents which are capable of specifically downregulating expression (or activity) of at least one of the polypeptide variants of the present invention.

Down regulating the expression of the therapeutic protein variants of the present invention may be achieved using oligonucleotide agents such as those described in greater detail below.

SiRNA molecules—Small interfering RNA (siRNA) molecules can be used to down-regulate expression of the therapeutic protein variants of the present invention. RNA interference is a two-step process. The first step, which is termed as the initiation step, input dsRNA is digested into 21-23 nucleotide (nt) small interfering RNAs (siRNA), probably by the action of Dicer, a member of the RNase III family of dsRNA-specific ribonucleases, which processes (cleaves) dsRNA (introduced directly or via a transgene or a virus) in an ATP-dependent manner. Successive cleavage events degrade the RNA to 19-21 bp duplexes (siRNA), each with 2-nucleotide 3' overhangs [Hutvagner and Zamore Curr. Opin. Genetics and Development 12:225-232 (2002); and Bernstein Nature 409:363-366 (2001)].

In the effector step, the siRNA duplexes bind to a nuclease complex to from the RNA-induced silencing complex (RISC). An ATP-dependent unwinding of the siRNA duplex is required for activation of the RISC. The active RISC then targets the homologous transcript by base pairing interactions and cleaves the mRNA into 12 nucleotide fragments from the 3' terminus of the siRNA [Hutvagner and Zamore Curr. Opin. Genetics and Development 12:225-232 (2002); Hammond et al. (2001) Nat. Rev. Gen. 2:110-119 (2001); and Sharp Genes. Dev. 15:485-90 (2001)]. Although the mechanism of cleavage is still to be elucidated, research indicates that each RISC contains a single siRNA and an RNase [Hutvagner and Zamore Curr. Opin. Genetics and Development 12:225-232 (2002)].

Because of the remarkable potency of RNAi, an amplification step within the RNAi pathway has been suggested. Amplification could occur by copying of the input dsRNAs which would generate more siRNAs, or by replication of the siRNAs formed. Alternatively or additionally, amplification could be effected by multiple turnover events of the RISC [Hammond et al. Nat. Rev. Gen. 2:110-119 (2001), Sharp Genes. Dev. 15:485-90 (2001); Hutvagner and Zamore Curr. Opin. Genetics and Development 12:225-232 (2002)]. For more information on RNAi see the following reviews Tuschl ChemBiochem. 2:239-245 (2001); Cullen Nat. Immunol. 3:597-599 (2002); and Brantl Biochem. Biophys. Act. 1575: 15-25 (2002).

Synthesis of RNAi molecules suitable for use with the present invention can be effected as follows. First, the mRNA sequence is scanned downstream of the AUG start codon for AA dinucleotide sequences. Occuffence of each AA and the 3'adjacent 19 nucleotides is recorded as potential siRNA target sites. Preferably, siRNA target sites are selected from the open reading frame, as untranslated regions (UTRs) are richer in regulatory protein binding sites. UTR-binding proteins and/or translation initiation complexes may interfere with binding of the siRNA endonuclease complex [Tuschl ChemBiochem. 2:239-245]. It will be appreciated though, that siRNAs directed at untranslated regions may also be effective, as demonstrated for GAPDH wherein siRNA directed at the 5'UTR mediated about 90% decrease in cellular GAPDH mRNA and completely abolished protein level.ambion. com/techlib/tn/91/912 .html).

Second, potential target sites are compared to an appropriate genomic database (e.g., human, mouse, rat etc.) using any sequence alignment software, such as the BLAST software available from the NCBJ server.ncbi.nlm. nihi.gov/BLAST/). Putative target sites which exhibit significant homology to other coding sequences are filtered out.

Qualifying target sequences are selected as template for siRNA synthesis. Preferred sequences are those including low G/C content as these have proven to be more effective in mediating gene silencing as compared to those with G/C content higher than 55%. Several target sites are preferably selected along the length of the target gene for evaluation. Target sites are selected from the unique nucleotide sequences of each of the polynucleotides of the present invention, such that each polynucleotide is specifically down regulated. For better evaluation of the selected siRNAs, a negative control is preferably used in conjunction. Negative control siRNA preferably include the same nucleotide composition as the siRNAs but lack significant homology to the genome. Thus, a scrambled nucleotide sequence of the siRNA is preferably used, provided it does not display any significant homology to any other gene.

DNAzyme molecules—Another agent capable of down-regulating expression of the polypeptides of the present invention is a DNAzyme molecule capable of specifically cleaving an mRNA transcript or DNA sequence of the polynucleotides of the present invention. DNAzymes are single-stranded polynucleotides which are capable of cleaving both single and double stranded target sequences (Breaker, R. R. and Joyce, G. Chemistry and Biology 1995;2:655; Santoro, S. W. & Joyce, G. F. Proc. Natl, Acad. Sci. USA 1997;943:4262) A general model (the "10-23" model) for the DNAzyme has been proposed. "10-23" DNAzymes have a catalytic domain of 15 deoxyribonucleotides, flanked by two substrate-recognition domains of seven to nine deoxyribonucleotides each. This type of DNAzyme can effectively cleave its substrate RNA at purine:pyrimidine junctions (Santoro, S. W. & Joyce, G. F. Proc. Natl, Acad. Sci. USA 199; for rev of DNAzymes see Khachigian, LM [Curr Opin Mol Ther 4:119-21 (2002)].

Target sites for DNAzymes are selected from the unique nucleotide sequences of each of the polynucleotides of the present invention, such that each polynucleotide is specifically down regulated.

Examples of construction and amplification of synthetic, engineered DNAzymes recognizing single and double-stranded target cleavage sites have been disclosed in U.S. Pat. No. 6,326,174 to Joyce et al. DNAzymes of similar design directed against the human Urokinase receptor were recently observed to inhibit Urokinase receptor expression, and successfully inhibit colon cancer cell metastasis in vivo (Itoh et al, 20002, Abstract 409, Ann Meeting Am Soc Gen Ther.as-gt.org). In another application, DNAzymes complementary to bcr-abl oncogenes were successful in inhibiting the oncogenes expression in leukemia cells, and lessening relapse rates in autologous bone marrow transplant in cases of CML and ALL.

Antisense molecules—Downregulation of the polynucleotides of the present invention can also be effected by using an antisense polynucleotide capable of specifically hybridizing with an mRNA transcript encoding the polypeptide variants of the present invention.

The term "antisense", as used herein, refers to any composition containing nucleotide sequences, which are complementary to a specific DNA or RNA sequence.

The term "antisense strand" is used in reference to a nucleic acid strand that is complementary to the "sense" strand. Antisense molecules also include peptide nucleic acids and may be produced by any method including synthesis or transcription. Once introduced into a cell, the complementary nucleotides combine with natural sequences produced by the cell to form duplexes and block either transcription or translation. The designation "negative" is sometimes used in reference to the antisense strand, and "positive" is sometimes used in reference to the sense strand. Antisense oligonucleotides are also used for modulation of alternative splicing in vivo and for diagnostics in vivo and in vitro (Khelifi C. et al., 2002, Current Pharmaceutical Design 8:451-1466; Sazani, P., and Kole. R. Progress in Molecular and Cellular Biology, 2003, 31:217-239).

Design of antisense molecules which can be used to efficiently downregulate expression of the polypeptides of the present invention must be effected while considering two aspects important to the antisense approach. The first aspect is delivery of the oligonucleotide into the cytoplasm of the appropriate cells, while the second aspect is design of an oligonucleotide which specifically binds the designated mRNA within cells in a way which inhibits translation thereof.

The prior art teaches of a number of delivery strategies which can be used to efficiently deliver oligonucleotides into a wide variety of cell types [see, for example, Luft J Mol Med 76: 75-6 (1998); Kronenwett et al. Blood 91: 852-62 (1998); Rajur et al. Bioconjug Chem 8: 935-40 (1997); Lavigne et al. Biochem Biophys Res Commun 237: 566-71 (1997) and Aoki et al. (1997) Biochem Biophys Res Commun 231: 540-5 (1997)].

In addition, algorithms for identifying those sequences with the highest predicted binding affinity for their target mRNA based on a thermodynamic cycle that accounts for the energetics of structural alterations in both the target mRNA and the oligonucleotide are also available [see, for example, Walton et al. Biotechnol Bioeng 65: 1-9 (1999)].

Such algorithms have been successfully used to implement an antisense approach in cells. For example, the algorithm developed by Walton et al. enabled scientists to successfully design antisense oligonucleotides for rabbit beta-globin (RBG) and mouse tumor necrosis factor-alpha (TNF alpha) transcripts. The same research group has more recently reported that the antisense activity of rationally selected oligonucleotides against three model target mRNAs (human lactate dehydrogenase A and B and rat gp130) in cell culture as evaluated by a kinetic PCR technique proved effective in almost all cases, including tests against three different targets in two cell types with phosphodiester and phosphorothioate oligonucleotide chemistries.

In addition, several approaches for designing and predicting efficiency of specific oligonucleotides using an in vitro system were also published (Matveeva et al., Nature Biotechnology 16: 1374-1375 (1998)].

Several clinical trials have demonstrated safety, feasibility and activity of antisense oligonucleotides. For example, antisense oligonucleotides suitable for the treatment of cancer have been successfully used [Holmund et al., Curr Opin Mol Ther 1:372-85 (1999)], while treatment of hematological malignancies via antisense oligonucleotides targeting c-myb gene, p 53 and Bcl-2 had entered clinical trials and had been shown to be tolerated by patients [Gerwitz Curr Opin Mol Ther 1:297-306 (1999)].

More recently, antisense-mediated suppression of human heparanase gene expression has been reported to inhibit pleural dissemination of human cancer cells in a mouse model [Uno et al., Cancer Res 61:7855-60 (2001)].

Thus, the current consensus is that recent developments in the field of antisense technology which, as described above, have led to the generation of highly accurate antisense design algorithms and a wide variety of oligonucleotide delivery systems, enable an ordinarily skilled artisan to design and implement antisense approaches suitable for downregulating expression of known sequences without having to resort to undue trial and error experimentation.

Target sites for antisense molecules are selected from the unique nucleotide sequences of each of the polynucleotides of the present invention, such that each polynucleotide is specifically down regulated.

Ribozymes—Another agent capable of downregulating expression of the polypeptides of the present invention is a ribozyme molecule capable of specifically cleaving an mRNA transcript encoding the polypeptide variants of the present invention. Ribozymes are being increasingly used for the sequence-specific inhibition of gene expression by the cleavage of mRNAs encoding proteins of interest [Welch et al., Curr Opin Biotechnol. 9:486-96 (1998)]. The possibility of designing ribozymes to cleave any specific target RNA has rendered them valuable tools in both basic research and therapeutic applications. In therapeutics area, ribozymes have been exploited to target viral RNAs in infectious diseases, dominant oncogenes in cancers and specific somatic mutations in genetic disorders [Welch et al., Clin Diagn Virol.

10:163-71 (1998)]. Most notably, several ribozyme gene therapy protocols for HIV patients are already in Phase 1 trials. More recently, ribozymes have been used for transgenic animal research, gene target validation and pathway elucidation. Several ribozymes are in various stages of clinical trials. ANGIOZYME was the first chemically synthesized ribozyme to be studied in human clinical trials. ANGIOZYME specifically inhibits formation of the VEGF-r (Vascular Endothelial Growth Factor receptor), a key component in the angiogenesis pathway. Ribozyme Pharmaceuticals, Inc., as well as other firms have demonstrated the importance of anti-angiogenesis therapeutics in animal models. HEPTAZYME, a ribozyme designed to selectively destroy Hepatitis C Virus (HCV) RNA, was found effective in decreasing Hepatitis C viral RNA in cell culture assays (Ribozyme Pharmaceuticals, Incorporated—WEB home page).

Alternatively, down regulation of the polypeptide variants of the present invention may be achieved at the polypeptide level using downregulating agents such as antibodies or antibody fragments capabale of specifically binding the polypeptides of the present invention and inhibiting the activity thereof (i.e., neutralizing antibodies). Such antibodies can be directed for example, to the heterodimerizing domain on the variant, or to a putative ligand binding domain. Further description of antibodies and methods of generating same is provided below.

Pharmaceutical Compositions and Delivery Thereof:

The present invention features a pharmaceutical composition comprising a therapeutically effective amount of a therapeutic agent according to the present invention, which is preferably an antibody or that specifically recognizes and binds to the therapeutic protein variant, but not to the corresponding full length known protein. Optionally and alternatively, the therapeutic agent could be a therapeutic protein variant as described herein.

The pharmaceutical composition according to the present invention is preferably used for the treatment of cluster-related diseases.

"Treatment" refers to both therapeutic treatment and prophylactic or preventative measures. Those in need of treatment include those already with the disorder as well as those in which the disorder is to be prevented. Hence, the mammal to be treated herein may have been diagnosed as having the disorder or may be predisposed or susceptible to the disorder. "Mammal" for purposes of treatment refers to any animal classified as a mammal, including humans, domestic and farm animals, and zoo, sports, or pet animals, such as dogs, horses, cats, cows, etc. Preferably, the mammal is human.

A "disorder" is any condition that would benefit from treatment with the agent according to the present invention. This includes chronic and acute disorders or diseases including those pathological conditions which predispose the mammal to the disorder in question. Non-limiting examples of disorders to be treated herein are described with regard to specific examples given herein.

The term "therapeutically effective amount" refers to an amount of agent according to the present invention that is effective to treat a disease or disorder in a mammal. In the case of cancer, the therapeutically effective amount of the agent may reduce the number of cancer cells; reduce the tumor size; inhibit (i.e., slow to some extent and preferably stop) cancer cell infiltration into peripheral organs; inhibit (i.e., slow to some extent and preferably stop) tumor metastasis; inhibit, to some extent, tumor growth; and/or relieve to some extent one or more of the symptoms associated with the cancer. To the extent the agent may prevent growth and/or kill existing cancer cells, it may be cytostatic and/or cytotoxic. For cancer therapy, efficacy can, for example, be measured by assessing the time to disease progression (TTP) and/or determining the response rate (RR).

The therapeutic agents of the present invention can be provided to the subject per se, or as part of a pharmaceutical composition where they are mixed with a pharmaceutically acceptable carrier.

As used herein a "pharmaceutical composition" refers to a preparation of one or more of the active ingredients described herein with other chemical components such as physiologically suitable carriers and excipients. The purpose of a pharmaceutical composition is to facilitate administration of a compound to an organism.

Herein the term "active ingredient" refers to the preparation accountable for the biological effect.

Hereinafter, the phrases "physiologically acceptable carrier" and "pharmaceutically acceptable carrier" which may be interchangeably used refer to a carrier or a diluent that does not cause significant irritation to an organism and does not abrogate the biological activity and properties of the administered compound. An adjuvant is included under these phrases. One of the ingredients included in the pharmaceutically acceptable carrier can be for example polyethylene glycol (PEG), a biocompatible polymer with a wide range of solubility in both organic and aqueous media (Mutter et al. (1979).

Herein the term "excipient" refers to an inert substance added to a pharmaceutical composition to further facilitate administration of an active ingredient. Examples, without limitation, of excipients include calcium carbonate, calcium phosphate, various sugars and types of starch, cellulose derivatives, gelatin, vegetable oils and polyethylene glycols.

Techniques for formulation and administration of drugs may be found in "Remington's Pharmaceutical Sciences," Mack Publishing Co., Easton, Penn., latest edition, which is incorporated herein by reference.

Suitable routes of administration may, for example, include oral, rectal, transmucosal, especially transnasal, intestinal or parenteral delivery, including intramuscular, subcutaneous and intramedullary injections as well as intrathecal, direct intraventricular, intravenous, intraperitoneal, intranasal, or intraocular injections. Alternately, one may administer a preparation in a local rather than systemic manner, for example, via injection of the preparation directly into a specific region of a patient's body.

Pharmaceutical compositions of the present invention may be manufactured by processes well known in the art, e.g., by means of conventional mixing, dissolving, granulating, dragee-making, levigating, emulsifying, encapsulating, entrapping or lyophilizing processes.

Pharmaceutical compositions for use in accordance with the present invention may be formulated in conventional manner using one or more physiologically acceptable carriers comprising excipients and auxiliaries, which facilitate processing of the active ingredients into preparations which, can be used pharmaceutically. Proper formulation is dependent upon the route of administration chosen.

For injection, the active ingredients of the invention may be formulated in aqueous solutions, preferably in physiologically compatible buffers such as Hank's solution, Ringer's solution, or physiological salt buffer. For transmucosal administration, penetrants appropriate to the barrier to be permeated are used in the formulation. Such penetrants are generally known in the art.

For oral administration, the compounds can be formulated readily by combining the active compounds with pharmaceutically acceptable carriers well known in the art. Such carriers enable the compounds of the invention to be formulated as tablets, pills, dragees, capsules, liquids, gels, syrups, slurries, suspensions, and the like, for oral ingestion by a patient. Pharmacological preparations for oral use can be made using a solid excipient, optionally grinding the resulting mixture, and processing the mixture of granules, after adding suitable auxiliaries if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carbomethylcellulose; and/or physiologically acceptable polymers such as polyvinylpyrrolidone (PVP). If desired, disintegrating agents may be added, such as cross-linked polyvinyl pyrrolidone, agar, or alginic acid or a salt thereof such as sodium alginate.

Dragee cores are provided with suitable coatings. For this purpose, concentrated sugar solutions may be used which may optionally contain gum arabic, talc, polyvinyl pyrrolidone, carbopol gel, polyethylene glycol, titanium dioxide, lacquer solutions and suitable organic solvents or solvent mixtures. Dyestuffs or pigments may be added to the tablets or dragee coatings for identification or to characterize different combinations of active compound doses.

Pharmaceutical compositions, which can be used orally, include push-fit capsules made of gelatin as well as soft, sealed capsules made of gelatin and a plasticizer, such as glycerol or sorbitol. The push-fit capsules may contain the active ingredients in admixture with filler such as lactose, binders such as starches, lubricants such as talc or magnesium stearate and, optionally, stabilizers. In soft capsules, the active ingredients may be dissolved or suspended in suitable liquids, such as fatty oils, liquid paraffin, or liquid polyethylene glycols. In addition, stabilizers may be added. All formulations for oral administration should be in dosages suitable for the chosen route of administration.

For buccal administration, the compositions may take the form of tablets or lozenges formulated in conventional manner.

For administration by nasal inhalation, the active ingredients for use according to the present invention are conveniently delivered in the form of an aerosol spray presentation from a pressurized pack or a nebulizer with the use of a suitable propellant, e.g., dichlorodifluoromethane, trichlorofluoromethane, dichloro-tetrafluoroethane or carbon dioxide. In the case of a pressurized aerosol, the dosage unit may be determined by providing a valve to deliver a metered amount. Capsules and cartridges of, e.g., gelatin for use in a dispenser may be formulated containing a powder mix of the compound and a suitable powder base such as lactose or starch.

The preparations described herein may be formulated for parenteral administration, e.g., by bolus injection or continuous infusion. Formulations for injection may be presented in unit dosage form, e.g., in ampoules or in multidose containers with optionally, an added preservative. The compositions may be suspensions, solutions or emulsions in oily or aqueous vehicles, and may contain formulatory agents such as suspending, stabilizing and/or dispersing agents.

Pharmaceutical compositions for parenteral administration include aqueous solutions of the active preparation in water-soluble form. Additionally, suspensions of the active ingredients may be prepared as appropriate oily or water based injection suspensions. Suitable lipophilic solvents or vehicles include fatty oils such as sesame oil, or synthetic fatty acids esters such as ethyl oleate, triglycerides or liposomes. Aqueous injection suspensions may contain substances, which increase the viscosity of the suspension, such as sodium carboxymethyl cellulose, sorbitol or dextran. Optionally, the suspension may also contain suitable stabilizers or agents which increase the solubility of the active ingredients to allow for the preparation of highly concentrated solutions.

Alternatively, the active ingredient may be in powder form for constitution with a suitable vehicle, e.g., sterile, pyrogen-free water based solution, before use.

The preparation of the present invention may also be formulated in rectal compositions such as suppositories or retention enemas, using, e.g., conventional suppository bases such as cocoa butter or other glycerides.

Pharmaceutical compositions suitable for use in context of the present invention include compositions wherein the active ingredients are contained in an amount effective to achieve the intended purpose. More specifically, a therapeutically effective amount means an amount of active ingredients effective to prevent, alleviate or ameliorate symptoms of disease or prolong the survival of the subject being treated.

Determination of a therapeutically effective amount is well within the capability of those skilled in the art.

For any preparation used in the methods of the invention, the therapeutically effective amount or dose can be estimated initially from in vitro assays. For example, a dose can be formulated in animal models and such information can be used to more accurately determine useful doses in humans.

Toxicity and therapeutic efficacy of the active ingredients described herein can be determined by standard pharmaceutical procedures in vitro, in cell cultures or experimental animals. The data obtained from these in vitro and cell culture assays and animal studies can be used in formulating a range of dosage for use in human. The dosage may vary depending upon the dosage form employed and the route of administration utilized. The exact formulation, route of administration and dosage can be chosen by the individual physician in view of the patient's condition. (See e.g., Fingl, et al., 1975, in "The Pharmacological Basis of Therapeutics", Ch. 1 p. 1).

Depending on the severity and responsiveness of the condition to be treated, dosing can be of a single or a plurality of administrations, with course of treatment lasting from several days to several weeks or until cure is effected or diminution of the disease state is achieved.

The amount of a composition to be administered will, of course, be dependent on the subject being treated, the severity of the affliction, the manner of administration, the judgment of the prescribing physician, etc.

Compositions including the preparation of the present invention formulated in a compatible pharmaceutical carrier may also be prepared, placed in an appropriate container, and labeled for treatment of an indicated condition.

Pharmaceutical compositions of the present invention may, if desired, be presented in a pack or dispenser device, such as an FDA approved kit, which may contain one or more unit dosage forms containing the active ingredient. The pack may, for example, comprise metal or plastic foil, such as a blister pack. The pack or dispenser device may be accompanied by instructions for administration. The pack or dispenser may also be accommodated by a notice associated with the container in a form prescribed by a governmental agency regulating the manufacture, use or sale of pharmaceuticals, which notice is reflective of approval by the agency of the form of the compositions or human or veterinary administration. Such notice, for example, may be of labeling approved by the U.S. Food and Drug Administration for prescription drugs or of an approved product insert.

Immunogenic Compositions:

A therapeutic agent according to the present invention may optionally be a molecule, which promotes a specific immunogenic response against at least one of the polypeptides of the present invention in the subject. The molecule can be polypeptide variants of the present invention, a fragment derived therefrom or a nucleic acid sequence encoding thereof. Although such a molecule can be provided to the subject per se, the agent is preferably administered with an immunostimulant in an immunogenic composiiton. An immunostimulant may be any substance that enhances or potentiates an immune response (antibody and/or cell-mediated) to an exogenous antigen. Examples of immunostimulants include adjuvants, biodegradable microspheres (e.g., polylactic galactide) and liposomes into which the compound is incorporated (see e.g., U.S. Pat. No. 4,235,877). Vaccine preparation is generally described in, for example, M. F. Powell and M. J. Newman, eds., "Vaccine Design (the subunit and adjuvant approach)," Plenum Press (NY, 1995).

Illustrative immunogenic compositions may contain DNA encoding one or more of the polypeptides as described above, such that the polypeptide is generated in situ. The DNA may be present within any of a variety of delivery systems known to those of ordinary skill in the art, including nucleic acid expression systems (see below), bacteria and viral expression systems. Numerous gene delivery techniques are well known in the art, such as those described by Rolland, Crit. Rev. Therap. Drug Carrier Systems 15:143-198, 1998, and references cited therein. Appropriate nucleic acid expression systems contain the necessary DNA sequences for expression in the subject (such as a suitable promoter and terminating signal). Bacterial delivery systems involve the administration of a bacterium (such as Bacillus-Calmette-Guerrin) that expresses an immunogenic portion of the polypeptide on its cell surface or secretes such an epitope. In a preferred embodiment, the DNA may be introduced using a viral expression system (e.g., vaccinia or other pox virus, retrovirus, or adenovirus), which may involve the use of a non-pathogenic (defective), replication competent virus. Suitable systems are disclosed, for example, in Fisher-Hoch et al., Proc. Natl. Acad. Sci. USA 86:317-321, 1989; Flexner et al., Ann. N.Y Acad. Sci. 569:86-103, 1989; Flexner et al., Vaccine 8:17-21, 1990; U.S. Pat. Nos. 4,603,112, 4,769,330, and 5,017,487; WO 89/01973; U.S. Pat. No. 4,777,127; GB 2,200,651; EP 0,345,242; WO 91/02805; Berkner, Biotechniques 6:616-627, 1988; Rosenfeld et al., Science 252:431-434, 1991; Kolls et al., Proc. Natl. Acad. Sci. USA 91:215-219, 1994; Kass-Eisler et al., Proc. Natl. Acad. Sci. USA 90:11498-11502, 1993; Guzman et al., Circulation 88:2838-2848, 1993; and Guzman et al., Cir. Res. 73:1202-1207, 1993. Techniques for incorporating DNA into such expression systems are well known to those of ordinary skill in the art. The DNA may also be "naked," as described, for example, in Ulmer et al., Science 259:1745-1749, 1993 and reviewed by Cohen, Science 259:1691-1692, 1993. The uptake of naked DNA may be increased by coating the DNA onto biodegradable beads, which are efficiently transported into the cells.

It will be appreciated that an immunogenic composition may comprise both a polynucleotide and a polypeptide component. Such immunogenic compositions may provide for an enhanced immune response.

Any of a variety of immunostimulants may be employed in the immunogenic compositions of this invention. For example, an adjuvant may be included. Most adjuvants contain a substance designed to protect the antigen from rapid catabolism, such as aluminum hydroxide or mineral oil, and a stimulator of immune responses, such as lipid A, Bortadella pertussis or Mycobacterium tuberculosis derived proteins. Suitable adjuvants are commercially available as, for example, Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Penn.); aluminum salts such as aluminum hydroxide gel (alum) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A and quil A. Cytokines, such as GM-CSF or interleukin-2,-7, or -12, may also be used as adjuvants.

The adjuvant composition may be designed to induce an immune response predominantly of the Th1 type. High levels of Th1-type cytokines (e.g., IFN-.gamma., TNF.alpha., IL-2 and IL-12) tend to favor the induction of cell mediated immune responses to an administered antigen. In contrast, high levels of Th2-type cytokines (e.g., IL-4, IL-5, IL-6 and IL-10) tend to favor the induction of humoral immune responses. Following application of an immunogenic composition as provided herein, the subject will support an immune response that includes Th1- and Th2-type responses. The levels of these cytokines may be readily assessed using standard assays. For a review of the families of cytokines, see Mosmann and Coffinan, Ann. Rev. Immunol. 7:145-173, 1989.

Preferred adjuvants for use in eliciting a predominantly Th1-type response include, for example, a combination of monophosphoryl lipid A, preferably 3-de-O-acylated monophosphoryl lipid A (3D-MPL), together with an aluminum salt. MPL adjuvants are available from Corixa Corporation (Seattle, Wash.; see U.S. Pat. Nos. 4,436,727; 4,877,611; 4,866,034 and 4,912,094). CpG-containing oligonucleotides (in which the CpG dinucleotide is unmethylated) also induce a predominantly Th1 response. Such oligonucleotides are well known and are described, for example, in WO 96/02555, WO 99/33488 and U.S. Pat. Nos. 6,008,200 and 5,856,462. Immunostimulatory DNA sequences are also described, for example, by Sato et al., Science 273:352, 1996. Another preferred adjuvant is a saponin, preferably QS21 (Aquila Biopharmaceuticals Inc., Framingham, Mass.), which may be used alone or in combination with other adjuvants. For example, an enhanced system involves the combination of a monophosphoryl lipid A and saponin derivative, such as the combination of QS21 and 3D-MPL as described in WO 94/00153, or a less reactogenic composition where the QS21 is quenched with cholesterol, as described in WO 96/33739. Other preferred formulations comprise an oil-in-water emulsion and tocopherol. A particularly potent adjuvant formulation involving QS21, 3D-MPL and tocopherol in an oil-in-water emulsion is described in WO 95/17210.

Other preferred adjuvants include Montanide ISA 720 (Seppic, France), SAF (Chiron, Calif., United States), ISCOMS (CSL), MF-59 (Chiron), the SBAS series of adjuvants (e.g., SBAS-2 or SBAS-4, available from SmithKline Beecham, Rixensart, Belgium), Detox (Corixa, Hamilton, Mont.), RC-529 (Corixa, Hamilton, Mont.) and other aminoalkyl glucosaminide 4-phosphates (AGPs), such as those described in pending U.S. patent application Ser. Nos. 08/853,826 and 09/074,720.

A delivery vehicle may be employed within the immunogenic composition of the present invention to facilitate production of an antigen-specific immune response that targets tumor cells. Delivery vehicles include antigen presenting cells (APCs), such as dendritic cells, macrophages, B cells, monocytes and other cells that may be engineered to be efficient APCs. Such cells may be genetically modified to increase the capacity for presenting the antigen, to improve activation and/or maintenance of the T cell response, to have anti-tumor effects per se and/or to be immunologically compatible with the receiver (i.e., matched HLA haplotype). APCs may generally be isolated from any of a variety of biological fluids and organs, including tumor and peritumoral tissues, and may be autologous, allogeneic, syngeneic or xenogeneic cells.

Dendritic cells are highly potent APCs (Banchereau and Steinman, Nature 392:245-251, 1998) and have been shown to be effective as a physiological adjuvant for eliciting prophylactic or therapeutic antitumor immunity (see Timmernan and Levy, Ann. Rev. Med. 50:507-529, 1999). In general, dendritic cells may be identified based on their typical shape (stellate in situ, with marked cytoplasmic processes (dendrites) visible in vitro), their ability to take up, process and present antigens with high efficiency and their ability to activate naive T cell responses. Dendritic cells may, of course, be engineered to express specific cell-surface receptors or ligands that are not commonly found on dendritic cells in vivo or ex vivo, and such modified dendritic cells are contemplated by the present invention. As an alternative to dendritic cells, secreted vesicles antigen-loaded dendritic cells (called exosomes) may be used within an immunogenic composition (see Zitvogel et al., Nature Med. 4:594-600, 1998).

Dendritic cells and progenitors may be obtained from peripheral blood, bone marrow, tumor-infiltrating cells, peritumoral tissues-infiltrating cells, lymph nodes, spleen, skin, umbilical cord blood or any other suitable tissue or fluid. For example, dendritic cells may be differentiated ex vivo by adding a combination of cytokines such as GM-CSF, IL-4, IL-13 and/or TNF.alpha. to cultures of monocytes harvested from peripheral blood. Alternatively, CD34 positive cells harvested from peripheral blood, umbilical cord blood or bone marrow may be differentiated into dendritic cells by adding to the culture medium combinations of GM-CSF, IL-3, TNF.alpha., CD40 ligand, LPS, flt3 ligand and/or other compound(s) that induce differentiation, maturation and proliferation of dendritic cells.

Dendritic cells are categorized as "immature" and "mature" cells, which allows a simple way to discriminate between two well characterized phenotypes. Immature dendritic cells are characterized as APC with a high capacity for antigen uptake and processing, which correlates with the high expression of Fcγ receptor and mannose receptor. The mature phenotype is typically characterized by a lower expression of these markers, but a high expression of cell surface molecules responsible for T cell activation such as class I and class II MHC, adhesion molecules (e.g., CD54 and CD11) and costimulatory molecules (e.g., CD40, CD80, CD86 and 4-1BB).

APCs may generally be transfected with at least one polynucleotide encoding a polypeptide of the present invention, such that variant II, or an immunogenic portion thereof, is expressed on the cell surface. Such transfection may take place ex vivo, and a composition comprising such transfected cells may then be used for therapeutic purposes, as described herein. Alternatively, a gene delivery vehicle that targets a dendritic or other antigen presenting cell may be administered to the subject, resulting in transfection that occurs in vivo. In vivo and ex vivo transfection of dendritic cells, for example, may generally be performed using any methods known in the art, such as those described in WO 97/24447, or the gene gun approach described by Mahvi et al., Immunology and cell Biology 75:456-460, 1997. Antigen loading of dendritic cells may be achieved by incubating dendritic cells or progenitor cells with a polypeptide of the present inventio, DNA (naked or within a plasmid vector) or RNA; or with antigen-expressing recombinant bacterium or viruses (e.g., vaccinia, fowlpox, adenovirus or lentivirus vectors). Prior to loading, the polypeptide may be covalently conjugated to an immunological partner that provides T cell help (e.g., a carrier molecule) such as described above. Alternatively, a dendritic cell may be pulsed with a non-conjugated immunological partner, separately or in the presence of the polypeptide.

SPECT for Cancer Detection

SPECT (Single-Photon-Emission Computed Tomography) is one of several nuclear imaging techniques. Generally, in nuclear imaging, a radioactive isotope is injected to, inhaled by or ingested by a patient. The isotope, provided as a radioactive-labeled pharmaceutical (radio-pharmaceutical) is chosen based on bio-kinetic properties that cause preferential uptake by different tissues. The gamma photons emitted by the radio-pharmaceutical are detected by radiation detectors outside the body, giving its spatial and uptake distribution within the body, with little trauma to the patient.

SPECT is based on conventional nuclear imaging technique and tomographic reconstruction methods, wherein projection (or planar) data acquired from different views around the patient are reconstructed, using image reconstruction methods, to generate cross-sectional images of the internally distributed radio-pharmaceuticals. SPECT images provide enhanced contrast, when compared with planer images obtained with conventional nuclear imaging methods.

A general nuclear-imaging detector comprises a NaI(T1) scintillation crystal, of a diameter large enough to image a significant part of the human body (typically 40 cm). An array of photo-multiplier tubes (PMTs) view scintillation crystal, to give positional sensitivity. Each PMT has an x and a y coordinate. When a photon is absorbed by scintillation crystal, light is generated. A number of PMTs receive the light and produce signals. The X and Y coordinates of the event are determined by the strength of the signals generated by each PMT. Semiconductors with high atomic numbers and relatively high densities such as CdZnTe, CdTe, HgI, InSb, Ge, GaAs, Si, PbCs, PbCs, PbS, or GaAlAs, have a high stopping power and can be used as gamma ray detectors with good photon detection efficiencies, good spatial resolution, and a relatively high photon-energy resolution. Solid state semiconductor gamma cameras generally comprise arrays of pixelated detector.

When a photon is incident on crystal, it generally loses all its energy in crystal by ionization and produces pairs of mobile electrons and holes in a localized region of crystal. As a result of the detector field, the holes drift to cathode and the electrons drift to anode, thereby inducing charges on anode pixels and cathode. The induced charges on anode pixels are sensed and generally partially processed by appropriate electronic circuits located in a detector base to which detector is mounted. Signals from the induced charges on pixels are used to determine the time at which a photon is detected, how much energy the detected photon deposited in the crystal and where in the crystal the photon interaction took place. Generally, a collimator is placed between scintillation crystal and the tissue. Commonly, collimator is honeycomb shaped, comprising a large number of holes separated by parallel lead septa. The purpose of collimator is to intercept and eliminate gamma-ray photons that are not traveling in an accepted direction, parallel to the lead septa.

A typical SPECT system consists of a single or multiple units of radiation detectors arranged in a specific geometric configuration, a mechanism for moving the radiation detectors and/or a specially designed collimator to acquire data from different projection views. A typical system is based on a single or multiple scintillation cameras, mounted on a rotating gantry. This may consist of a single-camera system, a dual-camera system, a triple-camera system or a quadruple-camera system. Generally, camera-based SPECT systems use Anger scintillation cameras such as those used in conventional planar nuclear medicine. These cameras allow for truly three-dimensional imaging, by providing a large set of contiguous trans-axial images that cover the entire organ of interest. They are easily adaptable for SPECT imaging of the brain or body, by simply changing the radius of rotation of the camera. Because of the relatively low counting rate capability, it is desirous to use two or more cameras. The increase in sensitivity per slice is proportional to the number of cameras.

In general, camera-based SPECT systems may be comprised of detectors that rotate about the region to be imaged or arrays of detectors that completely surround the region to be imaged, for example with a ring of detectors. In either event, the object of the imaging system is to acquire data from directions including at least 180 degrees of view.

For example, U.S. Pat. No. 6,696,686 describes the use of SPECT for detection of breast cancer, which is especially challenging, since there is no way to acquire cross-sectional data suitable for analytic tomographic reconstruction, especially from slices near the chest wall, from the front of the patient, since there is no way to acquire views of a slice over 180 degrees of view. U.S. Pat. No. 6,696,686 provides a small SPECT system, dedicated to the nuclear imaging of the breast. The SPECT system is positioned on a gantry, so as to be substantially parallel with the axis of the breast and perpendicular to the body. The axis of the breast is a vertical line passing through the nipple when the test subject is lying face downward and prone, with the breast passing through a hole in the surface supporting the patient or a similar line. The SPECT system rotates substantially around the axis of the breast. The patient may lay prone on a table, facing down, with the breast protruding through a hole in the table and thus pulled down by gravity. Additionally or alternatively, the breast may be pulled out by a vacuum pump.

For breast cancer detection a small multidetector SPECT system, dedicated to the nuclear imaging of the breast can be used. Such SPECT system comprises at least one gamma camera, of a size appropriate for the scanning of a breast, having a radiation detecting surface, which detects gamma radiation and provides data signals responsive to radiation from the breast. For example, an arrangement of four cameras, arranged in a square around the breast, can be used. The cameras may be rotated around the breast. Alternatively, a stationary circular ring of detectors can be used. Such SPECT system comprises a special collimator for improved imaging of the chest wall. For example, the collimator might comprise septa having a diverging field of view on the edge of the collimator adjacent to the chest wall (diverging-hole collimator). The direction of the septa might change away from the chest wall edge to provide a view parallel to the rotation axis (approximately equal to the axis of the breast). Optionally, the collimator might comprise septa near the center of the collimator which accept radiation from a direction perpendicular to the radiation detection surface and septa near an edge of the collimator which accept radiation from an outward facing acute angle to the perpendicular direction.

The breast cancer detection SPECT system comprises a gantry on which the radiation detector is mounted and which provides rotational movement of the radiation detection surface around the axis of the breast. The detector is a detector having an extent between 10 and 20 cm. The SPECT system contains a gamma camera comprising a gamma ray detector system and including a rotator that rotates the at least one detector surface about an axis parallel to and within the field of view of the detector surface, wherein the outward looking direction is at an acute angle with the axis. Optionally, the outward looking angle varies over the second portion, with the angle being 90 degrees near the first portion and a minimum value near at the second edge. The gamma ray detector system is sized and configured to rotate about a breast of a human patient, wherein the axis of rotation coincides generally with the axis of the breast.

The breast cancer detection SPECT system comprises a computer which receives and analyzes the data signals and constructs an image of radiation sources therefrom. The computer constructs the image of the radiation source utilizing an iterative approach for at least a portion of the volume for which data is acquired with the radiation detection surface at the angle. An analytic approach is used for at least a part of the volume for which data is acquired with the radiation detection surface parallel to the angle or rotation.

Actual Marker Examples

The markers of the present invention were tested with regard to their expression in various cancerous and non-cancerous tissue samples. A description of the samples used in the prostate cancer testing panel is provided in Table 2_1 below. A description of the samples used in the ovarian cancer testing panel is provided in Table 2_2 below. A description of the samples used in the colon cancer testing panel is provided in Table 2_3 below. A description of the samples used in the lung cancer testing panel is provided in Table 2_4 below. A description of the samples used in the breast cancer testing panel is provided in Table 2_5 below. A description of the samples used in the normal tissue panel is provided in Table 2_6 below. A description of the samples used in the chip lung panel is provided in Table 2_7 below. Tests were then performed as described in the "Materials and Experimental Procedures" section below.

TABLE 2_1

Tissue samples in prostate cancer testing panel

| Lot No. | | pathology | Sex/Age | Source |
|---|---|---|---|---|
| 66-A-Adeno G1 GS-4 | 160202 | Adenocarcinoma Gleason score 4 | M/64 | ABS |
| 73-A-Adeno G1 GS-4 | 16026T2 | Acinar Adenocarcinoma Gleason score 4(2 + 2) | M/77 | ABS |
| 68-A-Adeno G1 GS-5 | 160172 | Adenocarcinoma Gleason score 5 | M/66 | ABS |
| 56-Am-Adeno G1 GS-5 | 36467 | Adenocarcinoma, Gleason score 5(3 + 2); stage 2 | M/72 | Ambion |

TABLE 2_1-continued

Tissue samples in prostate cancer testing panel

| | Lot No. | pathology | Sex/Age | Source |
|---|---|---|---|---|
| 58-Am-Adeno G1 GS-5 | 37192 | Adenocarcinoma, Gleason score 5; stage 2 | M/52 | Ambion |
| 65-A-Adeno G2 GS-5 | 160022 | Adenocarcinoma Gleason score 5 | M/66 | ABS |
| 69-A-Adeno GS-5 | 160182 | Acinar Adenocarcinoma Gleason score 5 | M/58 | ABS |
| 55-Am-Adeno GS-5 | 36464 | Adenocarcinoma, Gleason score 5; stage 1 | M/53 | Ambion |
| 64-A-Adeno G2 GS-6 | 160092 | Acinar Adenocarcinoma Gleason score 6 | M/71 | ABS |
| 70-A-Adeno G2 GS-6 | 160192 | Adenocarcinoma Gleason score 6 | M/53 | ABS |
| 18-A-Adeno GS-6 | 5610020069T | Adenocarcinoma, Gleason score 6 (3 + 3) | M | ABS |
| 67-A-Adeno GS-6 | 160142 | Acinar Adenocarcinoma Gleason score 6 | M/62 | ABS |
| 25-A-Adeno GS-7 | 5605020052T | Adenocarcinoma, Gleason score 7 (4 + 3) | M | ABS |
| 26-A-Adeno GS-7 | 5609020067T | Adenocarcinoma, Gleason score 7 (4 + 3) | M | ABS |
| 72-A-Adeno GS-7 | 160122 | Acinar Adenocarcinoma Gleason score 7 | M/66 | ABS |
| 71-A-Adeno GS-7 | 160242 | Acinar Adenocarcinoma Gleason score 7 | M/70 | ABS |
| 57-Am-Adeno GS-7 | 26442 | Adenocarcinoma, Gleason score 7 | M/62 | Ambion |
| 32-A-Adeno GS-9 | 5604020042T | Adenocarcinoma, Gleason score 9 (5 + 4) | M | ABS |
| 54-B-Adeno G3 | A610031 | Adenocarcinoma | | Biochain |
| 33-A-BPH | 5607020058 | BPH | M | ABS |
| 34-A-BPH | 5607020059 | BPH | M | ABS |
| 35-A-BPH | 5607020060 | BPH | M | ABS |
| 43-B-PBH | A609267 | BPH | M/66 | Biochain |
| 44-B-PBH | A609268 | BPH | M/72 | Biochain |
| 45-B-PBH | A609269 | BPH | M/69 | Biochain |
| 46-B-PBH | A609270 | BPH | M/65 | Biochain |
| 47-B-PBH | A609271 | BPH | M/71 | Biochain |
| 40-A-N M26 | 5609020067N | Normal Matched | M | ABS |
| 41-A-N M32 | 5604020042N | Normal Matched | M | ABS |
| 48-B-N | A609257 | Normal PM | M/24 | Biochain |
| 49-B-N | A609256 | Normal PM | M/36 | Biochain |
| 50-B-N | A609255 | Normal PM | M/26 | Biochain |
| 51-B-N | A609258 | Normal PM | M/27 | Biochain |
| 52-B-N | A609254 | Normal PM | M/29 | Biochain |
| 53-Cl-N | 1070317 | Normal - Pool of 47 | M&F | Clontech |
| 42-Am-N | 061P04A | Normal (IC BLEED) | M/47 | ambion |
| 59-Am-N | 25955 | Normal PM (Head trauma) | M/62 | Ambion |
| 60-Am-N | 33605 | Normal PM (Myocardial infraction) | M/69 | Ambion |
| 61-Am-N | 34077 | Normal PM (Alzheimer's) | M/71 | Ambion |
| 62-Am-N | 31316 | Normal (Renal failure) | M/79 | Ambion |
| 63-Am-N | 30991 | Normal (Gall Bladder cancer) | M/78 | Ambion |

TABLE 2_2

Tissue samples in ovarian cancer testing panel

| Sample name | Lot number | Source | Tissue | Pathology | Grade | gender/ age | age |
|---|---|---|---|---|---|---|---|
| 33-B-Pap Sero CystAde G1 | A503175 | BioChain | ovary | Serous papillary cystadeno carcinoma | 1 | 41/F | 41 |
| 41-G-Mix Sero/Muc/Endo G2 | 98-03-G803 | GOG | ovary | Mixed epithelial cystadeno carcinoma with mucinous, endometrioid, | 2 | 38 | 38 |

TABLE 2_2-continued

Tissue samples in ovarian cancer testing panel

| Sample name | Lot number | Source | Tissue | Pathology | Grade | gender/age | age |
|---|---|---|---|---|---|---|---|
| | | | | squamous and papillary serous (Stage2) | | | |
| 35-G-Endo Adeno G2 | 94-08-7604 | GOG | right ovary | Endometrioid adenocarcinoma | 2 | 39/F | 39 |
| 14-B-Adeno G2 | A501111 | BioChain | ovary | Adenocarcinoma | 2 | 41/F | 41 |
| 12-B-Adeno G3 | A406023 | Biochain | ovary | Adenocarcinoma | 3 | 45/F | 45 |
| 40-G-Mix Sero/Endo G2 | 95-11-G006 | GOG | ovary, endometrium | Papillary serous and endometrioid cystadeno carcinoma (Stage3C) | 2 | 49/F | 49 |
| 4-A-Pap CystAdeno G2 | ILS-7286 | ABS | ovary | Papillary cystadeno carcinoma | 2 | 50/F | 50 |
| 3-A-Pap Adeno G2 | ILS-1431 | ABS | ovary | Papillary adenocarcinoma | 2 | 52/F | 52 |
| 2-A-Pap Adeno G2 | ILS-1408 | ABS | ovary | Papillary adenocarcinoma | 2 | 53/F | 53 |
| 5-G-Adeno G3 | 99-12-G432 | GOG | ovary | Adenocarcinoma (Stage3C) | 3 | 46/F | 46 |
| 11-B-Adeno G3 | A407068 | Biochain | ovary | Adenocarcinoma | 3 | 49/F | 49 |
| 39-G-Mix Sero/Endo G3 | 2001-12-G037 | GOG | ovary | Mixed serous and endometrioid adenocarcinoma | 3 | F | 49 |
| 29-G-Sero Adeno G3 | 2001-12-G035 | GOG | right ovary | Serous adenocarcinoma (Stage3A) | 3 | 50/F | 50 |
| 70-G-Pap Sero Adeno G3 | 95-08-G069 | GOG | ovary | Papillary serous adenocarcinoma | 3 | F/50 | 50 |
| 6-A-Adeno G3 | A0106 | ABS | ovary | adenocarcinoma | 3 | 51/F | 51 |
| 31-B-Pap Sero CystAde G3 | A503176 | BioChain | ovary | Serous papillary cystadeno carcinoma | 3 | 52/F | 52 |
| 25-A-Pap Sero Adeno G3 | N0021 | ABS | ovary | Papillary serous adenocarcinoma (StageT3CN1MX) | 3 | 55/F | 55 |
| 37-G-Mix Sero/Endo G3 | 2002-05-G513 | GOG | ovary | Mixed serous and endometrioid adenocarcinoma | 3 | 56/F | 56 |
| 7-A-Adeno G3 | IND-00375 | ABS | ovary | adenocarcinoma | 3 | 59/F | 59 |
| 8-B-Adeno G3 | A501113 | BioChain | ovary | adenocarcinoma | 3 | 60/F | 60 |
| 10-B-Adeno G3 | A407069 | Biochain | ovary | Adenocarcinoma | 3 | 60/F | 60 |
| 38-G-Mix Sero/Endo G3 | 2002-05-G509 | GOG | ovary | Mixed serous and endometrioid adenocarcinoma of mullerian (Stage3C) | 3 | 64/F | 64 |
| 13-G-Adeno G3 | 94-05-7603 | GOG | right ovary | Poorly differentiated adenocarcinoma from primary peritoneal | 3 | 67/F | 67 |
| 24-G-Pap Sero Adeno G3 | 2001-07-G801 | GOG | ovary | Papillary serous adenocarcinoma | 3 | 68/F | 68 |

TABLE 2_2-continued

Tissue samples in ovarian cancer testing panel

| Sample name | Lot number | Source | Tissue | Pathology | Grade | gender/age | age |
|---|---|---|---|---|---|---|---|
| 34-G-Pap Endo Adeno G3 | 95-04-2002 | GOG | ovary | Papillary endometrioid adenocarcinoma (Stage3C) | 3 | 68/F | 68 |
| 30-G-Pap Sero Adeno G3 | 2001-08-G011 | GOG | ovary | Papillary serous carcinoma (Stage1C) | 3 | 72/F | 72 |
| 1-A-Pap Adeno G3 | ILS-1406 | ABS | ovary | Papillary adenocarcinoma | 3 | 73/F | 73 |
| 9-G-Adeno G3 | 99-06-G901 | GOG | ovary | Adenocarcinoma (maybe serous) | 3 | 84/F | 84 |
| 32-G-Pap Sero CystAde G3 | 93-09-4901 | GOG | ovary | Serous papillary cystadeno carcinoma | 3 | F | 67 |
| 66-G-Pap Sero Adeno G3 SIV | 2000-01-G413 | GOG | ovary | Papillary serous carcinoma (metastais of primary peritoneum) (Stage4) | 3 | F | 67 |
| 19-B-Muc Adeno G3 | A504085 | BioChain | ovary | Mucinous adenocarcinoma | 3 | 34/F | 34 |
| 21-G-Muc CystAde G2-3 | 95-10-G020 | GOG | ovary | Mucinous cystadeno carcinoma (Stage2) | 2-3 | 44/F | 44 |
| 18-B-Muc Adeno G3 | A504083 | BioChain | ovary | Mucinous adenocarcinoma | 3 | 45/F | 45 |
| 20-A-Pap Muc CystAde | USA-00273 | ABS | ovary | Papillary mucinous cystadeno carcinoma | ?? | 46/F | 46 |
| 17-B-Muc Adeno G3 | A504084 | BioChain | ovary | Mucinous adenocarcinoma | 3 | 51/F | 51 |
| 22-A-Muc CystAde G2 | A0139 | ABS | ovary | Mucinous cystadeno carcinoma (Stage1C) | 2 | 72/F | 72 |
| 43-G-Clear cell Adeno G3 | 2001-10-G002 | GOG | ovary | Clear cell adenocarcinoma | 3 | 74/F | 74 |
| 44-G-Clear cell Adeno | 2001-07-G084 | GOG | ovary | Clear cell adenocarcinoma (Stage3A) | | 73/F | 73 |
| 15-B-Adeno G3 | A407065 | BioChain | ovary | Carcinoma | 3 | 27/F | 27 |
| 16-Ct-Adeno | 1090387 | Clontech | ovary | Carcinoma NOS | NA | 58/F | 58 |
| 23-A-Muc CystAde G3 | VNM-00187 | ABS | ovary | Mucinous cystadenocarcinoma with low malignant | 3 | 45/F | 45 |
| 42-G-Adeno borderline | 98-08-G001 | GOG | ovary | Epithelial adenocarcinoma of borderline malignancy | | 46/F | 46 |
| 63-G-Sero CysAdenoFibroma | 2000-10-G620 | GOG | ovary | Serous CysAdenoFibroma of borderline malignancy | | 71/F | 71 |
| 62-G-Ben Muc CysAdenoma | 99-10-G442 | GOG | ovary | Benbin mucinus cysadenoma | | 32/F | 32 |
| 60-G-Muc CysAdenoma | 99-01-G043 | GOG | ovary | Mucinous Cysadenoma | | 40/F | 40 |
| 56-G-Ben Muc CysAdeno | 99-01-G407 | GOG | left ovary | Bengin mucinus cysadenoma | | 46/F | 46 |

TABLE 2_2-continued

Tissue samples in ovarian cancer testing panel

| Sample name | Lot number | Source | Tissue | Pathology | Grade | gender/age | age |
|---|---|---|---|---|---|---|---|
| 64-G-Ben Sero CysAdenoma | 99-06-G039 | GOG | ovary | Bengin Serous CysAdenoma | | 57/F | 57 |
| 61-G-Muc CysAdenoma | 99-07-G011 | GOG | ovary | Mucinous Cysadenoma | | 63/F | 63 |
| 59-G-Sero CysAdenoFibroma | 98-12-G401 | GOG | ovary | Serous CysAdenoFibroma | | 77/F | 77 |
| 51-G-N M41 | 98-03-G803N | GOG | ovary | Normal (matched tumor 98-03-G803) | | 38/F | 38 |
| 75-G-N M60 | 99-01-G043N | GOG | ovary | Normal (matched tumor 99-01-G043) | | 40/F | 40 |
| 49-B-N M14 | A501112 | BioChain | ovary | Normal (matched tumor A501111) | | 41/F | 41 |
| 52-G-N M42 | 98-08-G001N | GOG | ovary | Normal (matched tumor 98-08-G001) | | 46/F | 46 |
| 68-G-N M56 | 99-01-G407N | GOG | ovary | Normal (matched bengin 99-01-G407) | | 46/F | 46 |
| 50-B-N M8 | A501114 | BioChain | ovary | Normal (matched tumor A501113) | | 60/F | 60 |
| 67-G-N M38 | 2002-05-509N | GOG | ovary | Normal (matched tumor 2002-05-G509) | | 64/F | 64 |
| 69-G-N M24 | 2001-07-G801N | GOG | ovary | Normal (matched tumor 2001-07-G801) | | 68/F | 68 |
| 73-G-N M59 | 98-12-G401N | GOG | ovary | Normal (matched tumor 98-12-G401) | | 77/F | 77 |
| 72-G-N M66 | 2000-01-G413N | GOG | ovary | Normal (matched tumor 2000-01-G413) | | F | F |
| 45-B-N | A503274 | BioChain | ovary | Normal PM | | 41/F | 41 |
| 46-B-N | A504086 | BioChain | ovary | Normal PM | | 41/F | 41 |
| 71-CG-N | CG-188-7 | Ichilov | ovary | Normal PM | | 49/F | 49 |
| 48-B-N | A504087 | BioChain | ovary | Normal PM | | 51/F | 51 |

TABLE 2_3

Tissue samples in colon cancer testing panel

| sample rename | Lot No. | tissue | source | pathology | Grade | gender/age |
|---|---|---|---|---|---|---|
| 58-B-Adeno G1 | A609152 | Colon | biochain | Adenocarcinoma | 1 | M/73 |
| 59-B-Adeno G1 | A609059 | Colon | biochain | Adenocarcinoma, Ulcer | 1 | M/58 |
| 14-CG- | CG-222 (2) | Rectum | Ichilov | Well polypoid | | F/49 |

TABLE 2_3-continued

Tissue samples in colon cancer testing panel

| sample rename | Lot No. | tissue | source | pathology | Grade | gender/age |
|---|---|---|---|---|---|---|
| Polypoid Adeno G1 D-C | | | | adeocarcinoma Duke's C | | |
| 17-CG-Adeno G1-2 | CG-163 | Rectum | Ichilov | Adenocarcinoma | 2 | M/73 |
| 10-CG-Adeno G1-2 D-B2 | CG-311 | Sigmod colon | Ichilov | Adenocarcinoma Astler-Coller B2. | 1-2 | M/88 |
| 11-CG-Adeno G1-2 D-C2 | CG-337 | Colon | Ichilov | Adenocarcinoma Astler-Coller C2. | 1-2 | NA |
| 6-CG-Adeno G1-2 D-C2 | CG-303 (3) | Colon | Ichilov | Adenocarcinoma Astler-Coller C2. | 1-2 | F/77 |
| 5-CG-Adeno G2 | CG-308 | Colon Sigma | Ichilov | Adenocarcinoma. | 2 | F/80 |
| 16-CG-Adeno G2 | CG-278C | colon | Ichilov | Adenocarcinoma | 2 | F/60 |
| 56-B-Adeno G2 | A609148 | Colon | biochain | Adenocarcinoma | 2 | F48 |
| 61-B-Adeno G2 | A606258 | Colon | biochain | Adenocarcinoma, Ulcer | 2 | M/41 |
| 60-B-Adeno G2 | A609058 | Colon | biochain | Adenocarcinoma, Ulcer | 2 | M/67 |
| 22-CG-Adeno G2 D-B | CG-229C | Colon | Ichilov | Adenocarcinoma Duke's B | 2 | F/55 |
| 1-CG-Adeno G2 D-B2 | CG-335 | Cecum | Ichilov | Adenocarcinoma Dukes B2. | 2 | F/66 |
| 12-CG-Adeno G2 D-B2 | CG-340 | Colon Sigma | Ichilov | Adenocarcinoma Astler-Coller B2. | 2 | M/66 |
| 28-CG-Adeno G2 D-B2 | CG-284 | sigma | Ichilov | Adenocarcinoma Duke's B2 | 2 | F/72 |
| 2-CG-Adeno G2 D-C2 | CG-307 X2 | Cecum | Ichilov | Adenocarcinoma Astler-Coller C2. | 2 | F/89 |
| 9-CG-Adeno G2 D-D | CG-297 X2 | Rectum | Ichilov | Adenocarcinoma Dukes D. | 2 | M/62 |
| 13-CG-Adeno G2 D-D | CG-290 X2 | Rectosigmoidal colon | Ichilov | Adenocarcinoma Dukes D. | 2 | M/47 |
| 26-CG-Adeno G2 D-D | CG-283 | sigma | Ichilov | Colonic adenocarcinoma Duke's D | 2 | F/63 |
| 4-CG-Adeno G3 | CG-276 | Colon | Ichilov | Carcinoma. | 3 | M/64 |
| 53-B-Adeno G3 | A609161 | Colon | biochain | Adenocarcinoma | 3 | F/53 |
| 54-B-Adeno G3 | A609142 | Colon | biochain | Adenocarcinoma | 3 | M/53 |
| 55-B-Adeno G3 | A609144 | Colon | biochain | Adenocarcinoma | 3 | M/68 |
| 57-B-Adeno G3 | A609150 | Colon | biochain | Adenocarcinoma | 3 | F/45 |
| 72-CG-Adeno G3 | CG-309 | colon | Ichilov | Adenocarcinoma | 3 | F/88 |
| 20-CG-Adeno G3 D-B2 | CG-249 | Colon | Ichilov | Ulcerated adenocarcinoma Duke's B2 | 3 | M/36 |
| 7-CG-Adeno D-A | CG-235 | Rectum | Ichilov | Adenocarcinoma intramucosal Duke's A. | UN | F/66 |
| 23-CG-Adeno D-C | CG-282 | sigma | Ichilov | Mucinus adenocarcinoma Astler Coller C | UN | M/51 |
| 3-CG-Muc adeno D-D | CG-224 | Colon | Ichilov | Mucinois adenocarcinoma Duke's D | UN | M/48 |
| 18-CG-Adeno | CG-22C | Colon | Ichilov | Adenocarcinoma | UN | NA |
| 19-CG-Adeno | CG-19C (1) | Colon | Ichilov | Adenocarcinoma | UN | NA |
| 21-CG-Adeno | CG-18C | Colon | Ichilov | Adenocarcinoma | UN | NA |
| 24-CG-Adeno | CG-12 (2) | Colon | Ichilov | Adenocarcinoma | UN | NA |
| 25-CG-Adeno | CG-2 | Colon | Ichilov | Adenocarcinoma | UN | NA |
| 27-CG-Adeno | CG-4 | Colon | Ichilov | Adenocarcinoma | UN | NA |
| 8-CG-diverticolosis, diverticulitis | CG-291 | Wall of sigma | Ichilov | Diverticolosis and diverticulitis of the Colon | | F/65 |
| 46-CG-Crohn's disease | CG-338C | Cecum | Ichilov | Crohn's disease | | M/22 |
| 47-CG-Crohn's disease | CG-338AC | Colon | Ichilov | Crohn's disease. | | M/22 |
| 42-CG-N M20 | CG-249N | Colon | Ichilov | Normal | | M/36 |
| 43-CG-N M8 | CG-291N | Wall of sigma | Ichilov | Normal | | F/65 |
| 44-CG-N M21 | CG-18N | Colon | Ichilov | Normal | | NA |
| 45-CG-N M11 | CG-337N | Colon | Ichilov | Normal | | M/75 |

TABLE 2__3-continued

Tissue samples in colon cancer testing panel

| sample rename | Lot No. | tissue | source | pathology | Grade | gender/age |
|---|---|---|---|---|---|---|
| 49-CG-N M14 | CG-222N | Rectum | Ichilov | Normal | | F/49 |
| 50-CG-N M5 | CG-308N | Sigma | Ichilov | Within normal limits | | F/80 |
| 51-CG-N M26 | CG-283N | Sigma | Ichilov | Normal | | F/63 |
| 41-B-N | A501156 | Colon | biochain | Normal PM | | M/78 |
| 52-CG-N | CG-309TR | Colon | Ichilov | Within normal limits | | F/88 |
| 62-B-N | A608273 | Colon | biochain | Normal PM | | M/66 |
| 63-B-N | A609260 | Colon | biochain | Normal PM | | M/61 |
| 64-B-N | A609261 | Colon | biochain | Normal PM | | F/68 |
| 65-B-N | A607115 | Colon | biochain | Normal PM | | M/24 |
| 66-B-N | A609262 | Colon | biochain | Normal PM | | M/58 |
| 67-B-N | A406029 | Colon | biochain | Normal PM (Pool 10) | | |
| 69-B-N | A411078 | Colon | biochain | Normal PM (Pool 10) | | F&M |
| 70-Cl-N | 1110101 | Colon | clontech | Normal PM (Pool of 3) | | |
| 71-Am-N | 071P10B | Colon | Ambion | Normal (IC BLEED) | | F/34 |

TABLE 2__4

Tissue samples in lung cancer testing panel

| sample rename | Lot No. | source | pathology | Grade | gender/age |
|---|---|---|---|---|---|
| 1-B-Adeno G1 | A504117 | Biochain | Adenocarcinoma | 1 | F/29 |
| 2-B-Adeno G1 | A504118 | Biochain | Adenocarcinoma | 1 | M/64 |
| 95-B-Adeno G1 | A610063 | Biochain | Adenocarcinoma | 1 | F/54 |
| 12-B-Adeno G2 | A504119 | Biochain | Adenocarcinoma | 2 | F/74 |
| 75-B-Adeno G2 | A609217 | Biochain | Adenocarcinoma | 2 | M/65 |
| 77-B-Adeno G2 | A608301 | Biochain | Adenocarcinoma | 2 | M/44 |
| 13-B-Adeno G2-3 | A504116 | Biochain | Adenocarcinoma | 2-3 | M/64 |
| 89-B-Adeno G2-3 | A609077 | Biochain | Adenocarcinoma | 2-3 | M/62 |
| 76-B-Adeno G3 | A609218 | Biochain | Adenocarcinoma | 3 | M/57 |
| 94-B-Adeno G3 | A610118 | Biochain | Adenocarcinoma | 3 | M/68 |
| 3-CG-Adeno | CG-200 | Ichilov | Adenocarcinoma | | NA |
| 14-CG-Adeno | CG-111 | Ichilov | Adenocarcinoma | | M/68 |
| 15-CG-Bronch adeno | CG-244 | Ichilov | Bronchioloalveolar adenocarcinoma | | M/74 |
| 45-B-Alvelous Adeno | A501221 | Biochain | Alveolus carcinoma | | F/50 |
| 44-B-Alvelous Adeno G2 | A501123 | Biochain | Alveolus carcinoma | 2 | F/61 |
| 19-B-Squamous G1 | A408175 | Biochain | Squamous carcinoma | 1 | M/78 |
| 16-B-Squamous G2 | A409091 | Biochain | Squamous carcinoma | 2 | F/68 |
| 17-B-Squamous G2 | A503183 | Biochain | Squamous carcinoma | 2 | M/57 |
| 21-B-Squamous G2 | A503187 | Biochain | Squamous carcinoma | 2 | M/52 |
| 78-B-Squamous G2 | A607125 | Biochain | Squamous Cell Carcinoma | 2 | M/62 |
| 80-B-Squamous G2 | A609163 | Biochain | Squamous Cell Carcinoma | 2 | M/74 |
| 18-B-Squamous G2-3 | A503387 | Biochain | Squamous Cell Carcinoma | 2-3 | M/63 |
| 81-B-Squamous G3 | A609076 | Biochain | Squamous Carcinoma | 3 | m/53 |
| 79-B-Squamous G3 | A609018 | Biochain | Squamous Cell Carcinoma | 3 | M/67 |
| 20-B-Squamous | A501121 | Biochain | Squamous Carcinoma | | M/64 |
| 22-B-Squamous | A503386 | Biochain | Squamous Carcinoma | | M/48 |
| 88-B-Squamous | A609219 | Biochain | Squamous Cell Carcinoma | | M/64 |
| 100-B-Squamous | A409017 | Biochain | Squamous Carcinoma | | M/64 |

TABLE 2_4-continued

Tissue samples in lung cancer testing panel

| sample rename | Lot No. | source | pathology | Grade | gender/age |
|---|---|---|---|---|---|
| 23-CG-Squamous | CG-109 (1) | Ichilov | Squamous Carcinoma | | M/65 |
| 24-CG-Squamous | CG-123 | Ichilov | Squamous Carcinoma | | M/76 |
| 25-CG-Squamous | CG-204 | Ichilov | Squamous Carcinoma | | M/72 |
| 87-B-Large cell G3 | A609165 | Biochain | Large Cell Carcinoma | 3 | F/47 |
| 38-B-Large cell | A504113 | Biochain | Large cell | | M/58 |
| 39-B-Large cell | A504114 | Biochain | Large cell | | F/35 |
| 82-B-Large cell | A609170 | Biochain | Large Cell Neuroendocrine Carcinoma | | M/68 |
| 30-B-Small cell carci G3 | A501389 | Biochain | small cell | 3 | M/34 |
| 31-B-Small cell carci G3 | A501390 | Biochain | small cell | 3 | F/59 |
| 32-B-Small cell carci G3 | A501391 | Biochain | small cell | 3 | M/30 |
| 33-B-Small cell carci G3 | A504115 | Biochain | small cell | 3 | M |
| 86-B-Small cell carci G3 | A608032 | Biochain | Small Cell Carcinoma | 3 | F/52 |
| 83-B-Small cell carci | A609162 | Biochain | Small Cell Carcinoma | | F/47 |
| 84-B-Small cell carci | A609167 | Biochain | Small Cell Carcinoma | | F/59 |
| 85-B-Small cell carci | A609169 | Biochain | Small Cell Carcinoma | | M/66 |
| 46-B-N M44 | A501124 | Biochain | Normal M44 | | F/61 |
| 47-B-N | A503205 | Biochain | Normal PM | | M/26 |
| 48-B-N | A503206 | Biochain | Normal PM | | M/44 |
| 49-B-N | A503384 | Biochain | Normal PM | | M/27 |
| 50-B-N | A503385 | Biochain | Normal PM | | M/28 |
| 90-B-N | A608152 | Biochain | Normal (Pool 2) PM | | pool 2 |
| 91-B-N | A607257 | Biochain | Normal (Pool 2) PM | | pool 2 |
| 92-B-N | A503204 | Biochain | Normal PM | | m/28 |
| 93-Am-N | 111P0103A | Ambion | Normal PM | | F/61 |
| 96-Am-N | 36853 | Ambion | Normal PM | | F/43 |
| 97-Am-N | 36854 | Ambion | Normal PM | | M/46 |
| 98-Am-N | 36855 | Ambion | Normal PM | | F/72 |
| 99-Am-N | 36856 | Ambion | Normal PM | | M/31 |

TABLE 2_5

Tissue samples in breast cancer testing panel

| sample rename | Lot no | source | pathology | grade | age | TNM | stage |
|---|---|---|---|---|---|---|---|
| 14-A-IDC G2 | A0135T | ABS | IDC | 2 | 37 | T2N2Mx | |
| 43-B-IDC G2 | A609183 | Biochain | IDC | 2 | 40 | | |
| 54-B-IDC G2 | A605353 | Biochain | IDC | 2 | 41 | | |
| 55-B-IDC G2 | A609179 | Biochain | IDC | 2 | 42 | | |
| 47-B-IDC G2 | A609221 | Biochain | IDC | 2 | 42 | | |
| 17-A-IDC G2 | 4904020036T | ABS | IDC | 2-3 | 42 | T3N1Mx | |
| 42-A-IDC G3 | 6005020031T | ABS | IDC | 3 | 42 | T1cN0Mx | |
| 7-A-IDC G2 | 7263T | ABS | IDC | 2 | 43 | T1N0M0 | stage 1 |
| 48-B-IDC G2 | A609222 | Biochain | IDC | 2 | 44 | | |
| 53-B-IDC G2 | A605151 | Biochain | IDC | 2 | 44 | | |
| 12-A-IDC G2 | 1432T | ABS | IDC | 2 | 46 | T2N0M0 | stage 2A |
| 61-B-IDC G2 | A610029 | Biochain | IDC | 2 | 46 | | |
| 46-B-Carci G2 | A609177 | Biochain | Carcinoma | 2 | 48 | | |
| 16-A-IDC G2 | 4904020032T | ABS | IDC | 2 | 49 | T3N1Mx | |
| 62-B-IDC G2 | A609194 | Biochain | IDC | 2 | 51 | | |
| 49-B-IDC G2 | A609223 | Biochain | IDC | 2 | 54 | | |
| 32-A-Muc Carci | 7116T | ABS | Mucinous carcinoma | | 54 | T2N0M0 | stage 2A |
| 45-B-IDC G2 | A609181 | Biochain | IDC | 2 | 58 | | |

TABLE 2_5-continued

Tissue samples in breast cancer testing panel

| sample rename | Lot no | source | pathology | grade | age | TNM | stage |
|---|---|---|---|---|---|---|---|
| 15-A-IDC G2 | 7259T | ABS | IDC | 2 | 59 | T3N1M0 | stage 3A |
| 52-B-ILC G1 | A605360 | Biochain | Invasive Lobular Carcinoma | 1 | 60 | | |
| 6-A-IDC G1 | 7238T | ABS | IDC | 1 | 60 | T2N0M0 | stage 2A |
| 26-A-IDC G3 | 7249T | ABS | IDC | 3 | 60 | T2N0M0 | stage 2A |
| 13-A-IDC G2 | A0133T | ABS | IDC | 2 | 63 | T2N1aMx | |
| 50-B-IDC G2 | A609224 | Biochain | IDC | 2 | 69 | | |
| 44-B-IDC G2 | A609198 | Biochain | IDC | 2 | 77 | | |
| 51-B-IDC G1 | A605361 | Biochain | IDC | 1 | 79 | | |
| 31-CG-IDC | CG-154 | Ichilov | IDC | | 83 | | |
| 27-A-IDC G3 | 4907020072T | ABS | IDC | 3 | 91 | T2N0Mx | |
| 36-A-N M7 | 7263N | ABS | Normal matched to 7T | | 43 | | |
| 40-A-N M12 | 1432N | ABS | Normal matched to 12T | | 46 | | |
| 39-A-N M15 | 7259N | ABS | Normal matched to 15T | | 59 | | |
| 35-A-N M6 | 7238N | ABS | Normal matched to 6T | | 60 | | |
| 41-A-N M26 | 7249N | ABS | Normal matched to 26T | | 60 | | |
| 51-B-N | A609233 | Biochain | Normal PM | | 34 | | |
| 59-B-N | A607155 | Biochain | Normal PM | | 35 | | |
| 60-B-N | A609234 | Biochain | Normal PM | | 36 | | |
| 63-Am-N | 26486 | Ambion | Normal PS | | 43 | | |
| 66-Am-N | 36678 | Ambion | Normal PM | | 45 | | |
| 64-Am-N | 23036 | Ambion | Normal PM | | 57 | | |
| 56-B-N | A609235 | Biochain | Normal PM | | 59 | | |
| 65-Am-N | 31410 | Ambion | Normal PM | | 63 | | |
| 67-Am-N | 073P010602086A | Ambion | Normal PM | | 64 | | |
| 58-B-N | A609232 | Biochain | Normal PM | | 65 | | |

TABLE 2_6

Tissue samples in normal panel:

| | Lot no. | Source | Tissue | Pathology | Sex/Age | comments |
|---|---|---|---|---|---|---|
| 1-Am-Colon (C71) | 071P10B | Ambion | Colon | PM IC bleed | F/43 | IC-intracarnial bleed |
| 2-B-Colon (C69) | A411078 | Biochain | Colon | PM-Pool of 10 | M (26-78) &F(53-77) | |
| 3-Cl-Colon (C70) | 1110101 | Clontech | Colon | PM-Pool of 3 sudden death | M&F (20-50) | |
| 4-Am-Small Intestine | 091P0201A | Ambion | Small Intestine | PM ICH | M/85 | |
| 5-B-Small Intestine | A501158 | Biochain | Small Intestine | PM | M/63 | |
| 6-B-Rectum | A605138 | Biochain | Rectum | PM | M/25 | |
| 7-B-Rectum | A610297 | Biochain | Rectum | PM | M/24 | |

TABLE 2_6-continued

Tissue samples in normal panel:

| | Lot no. | Source | Tissue | Pathology | Sex/Age | comments |
|---|---|---|---|---|---|---|
| 8-B-Rectum | A610298 | Biochain | Rectum | PM | M/27 | |
| 9-Am-Stomach | 110P04A | Ambion | Stomach | PM GSW | M/16 | |
| 10-B-Stomach | A501159 | Biochain | Stomach | PM | M/24 | |
| 11-B-Esophagus | A603814 | Biochain | Esophagus | PM | M/26 | |
| 12-B-Esophagus | A603813 | Biochain | Esophagus | PM | M/41 | |
| 13-Am-Pancreas | 071P25C | Ambion | Pancreas | PM MVA | F/25 | |
| 14-CG-Pancreas | CG-255-2 | Ichilov | Pancreas | PM | M/75 | |
| 15-B-Lung | A409363 | Biochain | Lung | PM-Pool of 5 | M(24-28) &F62 | |
| 16-Am-Lung (L93) | 111P0103A | Ambion | Lung | PM ICH | F/61 | |
| 17-B-Lung (L92) | A503204 | Biochain | Lung | PM | M/28 | |
| 19-B-Ovary (O48) | A504087 | Biochain | Ovary | PM | F/51 | |
| 20-B-Ovary (O46) | A504086 | Biochain | Ovary | PM | F/41 | |
| 75-G-Ovary | L629FRV1 | GCI | Ovary | PS DIGESTIVE HEMORRHAGE (ALCOHOLISM) | F/47 | |
| 76-G-Ovary | DWHTZRQX | GCI | Ovary | PS LEIOMYOMAS | F/42 | |
| 77-G-Ovary | FDPL9NJ6 | GCI | Ovary | PS VAGINAL BLEEDING | F/56 | |
| 78-G-Ovary | GWXUZN5M | GCI | Ovary | PS ABNORMAL PAP SMEARS | F/53 | |
| 21-Am-Cervix | 101P0101A | Ambion | Cervix | PM Surgery | F/40 | |
| 23-B-Cervix | A504089 | Biochain | Cervix | PM-Pool of 5 | F (36-55) | |
| 24-B-Uterus | A411074 | Biochain | Uterus | PM-Pool of 10 | F (32-53) | |
| 25-B-Uterus | A409248 | Biochain | Uterus | PM | F/35 | |
| 26-B-Uterus | A504090 | Biochain | Uterus | PM-Pool of 5 | F(40-53) | |
| 28-Am-Bladder | 071P02C | Ambion | Bladder | PM GSW | M/28 | |
| 29-B-Bladder | A504088 | Biochain | Bladder | PM-Pool of 5 | M(26-44) &F30 | |
| 30-Am-Placenta | 021P33A | Ambion | Placenta | PB | F/33 | PB - post birth |
| 31-B-Placenta | A410165 | Biochain | Placenta | PB | F/26 | |
| 32-B-Placenta | A411073 | Biochain | Placenta | PB-Pool of 5 | F(24-30) | |
| 33-B-Breast (B59) | A607155 | Biochain | Breast | PM | F/36 | |
| 34-Am-Breast (B63) | 26486 | Ambion | Breast | PS bilateral breast reduction | F/43 | |
| 35-Am-Breast (B64) | 23036 | Ambion | Breast | PM lung cancer | F/57 | |
| 36-Cl-Prostate (P53) | 1070317 | Clontech | Prostate | PM-Pool of 47 sudden death | M (14-57) | |
| 37-Am-Prostate (P42) | 061P04A | Ambion | Prostate | PM IC bleed | M/47 | |

TABLE 2_6-continued

Tissue samples in normal panel:

| | Lot no. | Source | Tissue | Pathology | Sex/Age | comments |
|---|---|---|---|---|---|---|
| 38-Am-Prostate (P59) | 25955 | Ambion | Prostate | PM head trauma | M/62 | |
| 39-Am-Testis | 111P0104A | Ambion | Testis | PM GSW | M/25 | |
| 40-B-Testis | A411147 | Biochain | Testis | PM | M/74 | |
| 41-Cl-Testis | 1110320 | Clontech | Testis | PM-Pool of 45 sudden death | M (14-64) | |
| 42-CG-Adrenal | CG-184-10 | Ichilov | Adrenal | PM | F/81 | |
| 43-B-Adrenal | A610374 | Biochain | Adrenal | PM | F/83 | |
| 44-B-Heart | A411077 | Biochain | Heart | PM-Pool of 5 | M(23-70) | |
| 45-CG-Heart | CG-255-9 | Ichilov | Heart focal fibrosis | PM | M/75 | |
| 46-CG-Heart | CG-227-1 | Ichilov | Heart | PM | F/36 | |
| 47-Am-Liver | 081P0101A | Ambion | Liver | PM ICH | M/64 | |
| 48-CG-Liver | CG-93-3 | Ichilov | Liver | PM | F/19 | |
| 49-CG-Liver | CG-124-4 | Ichilov | Liver of fetus | PM | fetus | |
| 50-Cl-BM | 1110932 | Clontech | Bone Marrow | PM-Pool of 8 sudden death | M&F (22-65) | |
| 51-CGEN-Blood | WBC#5 | CGEN | Blood | — | M | |
| 52-CGEN-Blood | WBC#4 | CGEN | Blood | — | M | |
| 53-CGEN-Blood | WBC#3 | CGEN | Blood | — | M | |
| 54-CG-Spleen | CG-267 | Ichilov | Spleen | PM | F/25 | |
| 55-CG-Spleen | 111P0106B | Ambion | Spleen | PM GSW | M/25 | |
| 56-CG-Spleen | A409246 | Biochain | Spleen | PM | F/12 | |
| 57-CG-Thymus | CG-98-7 | Ichilov | Thymus | PM | F/28 | |
| 58-Am-Thymus | 101P0101A | Ambion | Thymus | PM head injury | M/14 | |
| 59-B-Thymus | A409278 | Biochain | Thymus | PM | M/28 | |
| 60-B-Thyroid | A610287 | Biochain | Thyroid | PM | M/27 | |
| 61-B-Thyroid | A610286 | Biochain | Thyroid | PM | M/24 | |
| 62-CG-Thyroid | CG-119-2 | Ichilov | Thyroid | PM | F/66 | |
| 63-Cl-Salivary Gland | 1070319 | Clontech | Salivary Gland | PM-Pool of 24 sudden death | M&F 15-60 | |
| 64-Am-Kidney | 111P0101B | Ambion | Kidney | PM ICH | M 60 | |
| 65-Cl-Kidney | 1110970 | Clontech | Kidney | PM-Pool of 14 sudden death | M&F 18-59 | |
| 66-B-Kidney | A411080 | Biochain | Kidney | PM-Pool of 5 | M24-46 | |
| 67-CG-Cerebellum | CG-183-5 | Ichilov | Cerebellum | PM | M/74 | |
| 68-CG-Cerebellum | CG-212-5 | Ichilov | Cerebellum | PM | M/54 | |
| 69-B-Brain | A411322 | Biochain | Brain | PM | M/28 | |
| 70-Cl-Brain | 1120022 | Clontech | Brain | PM | — | |
| 71-B-Brain | A411079 | Biochain | Brain | PM-Pool of 2 | M27-28 | |
| 72-CG-Brain | CG-151-1 | Ichilov | Brain | PM | F/86 | |
| 73-Am-Skeletal Muscle | 101P013A | Ambion | Skeletal Muscle | PM head injury | F/28 | |

TABLE 2_6-continued

Tissue samples in normal panel:

| | Lot no. | Source | Tissue | Pathology | Sex/Age | comments |
|---|---|---|---|---|---|---|
| 74-Cl-Skeletal Muscle | 1061038 | Clontech | Skeletal Muscle | PM-Pool of 2 sudden death | M&F 43-46 | |
| 18-Am-Ovary (O47) | 061P43A | Ambion | Ovary | PM | F/16 | |
| 22-B-Cervix | A408211 | Biochain | Cervix | PM | F/36 | |
| 27-B-Bladder | A501157 | Biochain | Bladder | PM | M/29 | |

TABLE 2_7

Lung chip panel

| Name on array | RNA sample | Lot # | Source | Pathology | Grade | Sex/Age |
|---|---|---|---|---|---|---|
| LN-1 | 48-B-N | A503206 | Biochain | Normal PM | | M/44 |
| LN-2 | 50-B-N | A503385 | Biochain | Normal PM | | M/28 |
| LN-3 | 90-B-N | A608152 | Biochain | Normal (Pool 2) PM | | pool 2 |
| LN-4 | 91-B-N | A607257 | Biochain | Normal (Pool 2) PM | | pool 2 |
| LN-5 | 92-B-N | A503204 | Biochain | Normal PM | | m/28 |
| LN-6 | 96-Am-N | 36853 | Ambion | Normal PM | | F/43 |
| LN-7 | 97-Am-N | 36854 | Ambion | Normal PM | | M/46 |
| LN-8 | 98-Am-N | 36855 | Ambion | Normal PM | | F/72 |
| LN-9 | 99-Am-N | 36856 | Ambion | Normal PM | | M/31 |
| LSQ-2 | 25-CG-Squamous | CG-204 | Ichilov | Squamous Carcinoma | | M/72 |
| LSQ-3 | 22-B-Squamous | A503386 | Biochain | Squamous Carcinoma | | M/48 |
| LSQ-4 | 88-B-Squamous | A609219 | Biochain | Squamous Cell Carcinoma | | M/64 |
| LSQ-5 | 100-B-Squamous | A409017 | Biochain | Squamous Carcinoma | | M/64 |
| LSQ-6 | 78-B-Squamous G2 | A607125 | Biochain | Squamous Cell Carcinoma | 2 | M/62 |
| LSQ-7 | 81-B-Squamous G3 | A609076 | Biochain | Squamous Carcinoma | 3 | m/53 |
| LSQ-8 | 17-B-Squamous G2 | A503183 | Biochain | Squamous carcinoma | 2 | M/57 |
| LAC-1 | 95-B-Adeno G1 | A610063 | Biochain | Adeno carcinoma | 1 | F/54 |
| LAC-2 | 75-B-Adeno G2 | A609217 | Biochain | Adeno carcinoma | 2 | M/65 |
| LAC-3 | 77-B-Adeno G2 | A608301 | Biochain | Adeno carcinoma | 2 | M/44 |
| LAC-4 | 89-B-Adeno G2-3 | A609077 | Biochain | Adeno carcinoma | 2-3 | M/62 |
| LAC-5 | 76-B-Adeno G3 | A609218 | Biochain | Adeno carcinoma | 3 | M/57 |
| LAC-6 | 3-CG-Adeno | CG-200 | Ichilov | Adeno carcinoma | | NA |
| LAC-7 | 14-CG-Adeno | CG-111 | Ichilov | Adeno carcinoma | | M/68 |
| LSCC-1 | 30-B-Small cell carci G3 | A501389 | Biochain | small cell | 3 | M/34 |
| LSCC-2 | 31-B-Small cell carci G3 | A501390 | Biochain | small cell | 3 | F/59 |

TABLE 2_7-continued

Lung chip panel

| Name on array | RNA sample | Lot # | Source | Pathology | Grade | Sex/Age |
|---|---|---|---|---|---|---|
| LSCC-3 | 32-B-Small cell carci G3 | A501391 | Biochain | small cell | 3 | M/30 |
| LSCC-4 | 83-B-Small cell carci | A609162 | Biochain | Small Cell Carcinoma | | F/47 |
| LSCC-5 | 84-B-Small cell carci | A609167 | Biochain | Small Cell Carcinoma | | F/59 |
| LSCC-7 | 86-B-Small cell carci G3 | A608032 | Biochain | small cell | 3 | F/52 |
| LSCC-8 | 85-B-Small cell carci | A609169 | Biochain | small cell | | M/66 |

Materials and Experimental Procedures

RNA preparation--RNA was obtained from Clontech (Franklin Lakes, N.J. USA 07417, .clontech.com), BioChain Inst. Inc. (Hayward, Calif. 94545 USA.biochain.com), ABS (Wilmington, Del. 19801, USA,.absbioreagents.com) or Ambion (Austin, Tex. 78744 USA,.ambion.com). Alternatively, RNA was generated from tissue samples using TRI-Reagent (Molecular Research Center), according to Manufacturer's instructions. Tissue and RNA samples were obtained from patients or from postmortem. Total RNA samples were treated with DNaseI (Ambion) and purified using RNeasy columns (Qiagen).

RT PCR—Purified RNA (1 µg) was mixed with 150 ng Random Hexamer primers (Invitrogen) and 500 µM dNTP in a total volume of 15.6 µl. The mixture was incubated for 5 min at 65° C. and then quickly chilled on ice. Thereafter, 5 µl of 5× SuperscriptII first strand buffer (Invitrogen), 2.4 µl 0.1M DTT and 40 units RNasin (Promega) were added, and the mixture was incubated for 10 min at 25° C., followed by further incubation at 42° C. for 2 min. Then, 1 µl (200 units) of SuperscriptII (Invitrogen) was added and the reaction (final volume of 25 µl) was incubated for 50 min at 42° C. and then inactivated at 70° C. for 15 min. The resulting cDNA was diluted 1:20 in TE buffer (10 mM Tris pH=8, 1 mM EDTA pH=8).

Figure 5:
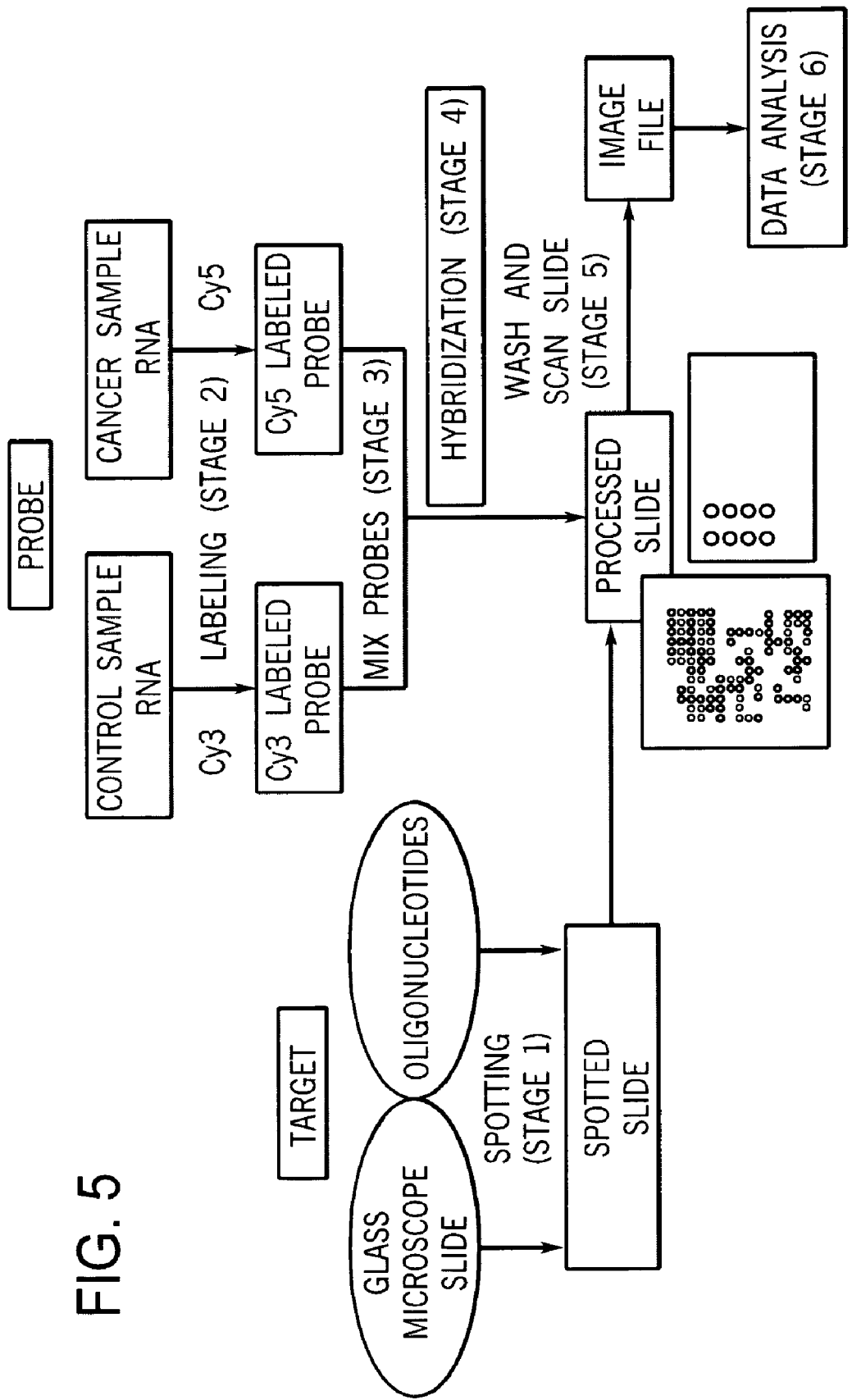
FIG. 5 is schematic summary of the oligonucleotide based microarray experimental flow.

Real-Time RT-PCR analysis—cDNA (5 µl), prepared as described above, was used as a template in Real-Time PCR reactions using the SYBR Green I assay (PE Applied Biosystem) with specific primers and UNG Enzyme (Eurogentech or ABI or Roche). The amplification was effected as follows: 50° C. for 2 min, 95° C. for 10 min, and then 40 cycles of 95° C. for 15 sec, followed by 60° C. for 1 min. Detection was performed by using the PE Applied Biosystem SDS 7000. The cycle in which the reactions achieved a threshold level (Ct) of fluorescence was registered and was used to calculate the relative transcript quantity in the RT reactions. The relative quantity was calculated using the equation $Q=efficiency^{-Ct}$. The efficiency of the PCR reaction was calculated from a standard curve, created by using serial dilutions of several reverse transcription (RT) reactions. To minimize inherent differences in the RT reaction, the resulting relative quantities were normalized to the geometric mean of the relative quantities of several housekeeping (HSKP) genes. Schematic summary of quantitative real-time PCR analysis is presented in FIG. 5. As shown, the x-axis shows the cycle number. The $C_T$=Threshold Cycle point, which is the cycle that the amplification curve crosses the fluorescence threshold that was set in the experiment. This point is a calculated cycle number in which PCR product signal is above the background level (passive dye ROX) and still in the Geometric/Exponential phase (as shown, once the level of fluorescence crosses the measurement threshold, it has a geometrically increasing phase, during which measurements are most accurate, followed by a linear phase and a plateau phase; for quantitative measurements, the latter two phases do not provide accurate measurements). The y-axis shows the normalized reporter fluorescence. It should be noted that this type of analysis provides relative quantification.

The sequences of the housekeeping genes measured in all the examples below on prostate panel were as follows:

```
SDHA (GenBank Accession No. NM_004168 (SEQ ID NO: 462))

SDHA Forward primer (SEQ ID NO: 463):
TGGGAACAAGAGGGCATCTG

SDHA Reverse primer (SEQ ID NO: 464):
CCACCACTGCATCAAATTCATG

SDHA-amplicon (SEQ ID NO: 465):
TGGGAACAAGAGGGCATCTGCTAAAGTTTCAGATTCCATTTCTGCTCAGTATCCAGTA

GTGGATCATGAATTTGATGCAGTGGTGG

PBGD (GenBank Accession No. BC019323 (SEQ ID NO: 430)),

PBGD Forward primer (SEQ ID NO: 431):
TGAGAGTGATTCGCGTGGG
```

-continued

PBGD Reverse primer (SEQ ID NO: 432):
CCAGGGTACGAGGCTTTCAAT

PBGD-amplicon (SEQ ID NO: 433):
TGAGAGTGATTCGCGTGGGTACCCGCAAGAGCCAGCTTGCTCGCATACAGACGGACA

GTGTGGTGGCAACATTGAAAGCCTCGTACCCTGG

HPRT1 (GenBank Accession No. NM_000194 (SEQ ID NO: 434)),

HPRT1 Forward primer (SEQ ID NO: 435):
TGACACTGGCAAAACAATGCA

HPRT1 Reverse primer (SEQ ID NO: 436):
GGTCCTTTTCACCAGCAAGCT

HPRT1-amplicon (SEQ ID NO: 437):
TGACACTGGCAAAACAATGCAGACTTTGCTTTCCTTGGTCAGGCAGTATAATCCAAAG

ATGGTCAAGGTCGCAAGCTTGCTGGTGAAAAGGACC

RPL19 (GenBank Accession No. NM_000981 (SEQ ID NO: 450)

RPL19Forward primer (SEQ ID NO: 451):
TGGCAAGAAGAAGGTCTGGTTAG

RPL19Reverse primer (SEQ ID NO: 452):
TGATCAGCCCATCTTTGATGAG

RPL19-amplicon (SEQ ID NO: 453):
TGGCAAGAAGAAGGTCTGGTTAGACCCCAATGAGACCAATGAAATCGCCAATGCCAA

CTCCCGTCAGCAGATCCGGAAGCTCATCAAAGATGGGCTGATCA

The sequences of the housekeeping genes measured in all the examples on ovarian cancerpanel were as follows:

SDHA (GenBank Accession No. NM_004168 (SEQ ID NO: 462))

SDHA Forward primer (SEQ ID NO: 463):
TGGGAACAAGAGGGCATCTG

SDHA Reverse primer (SEQ ID NO: 464):
CCACCACTGCATCAAATTCATG

SDHA-amplicon (SEQ ID NO: 465):
TGGGAACAAGAGGGCATCTGCTAAAGTTTCAGATTCCATTTCTGCTCAGTATCCAGTA

GTGGATCATGAATTTGATGCAGTGGTGG

PBGD (GenBank Accession No. BC019323 (SEQ ID NO: 430)),

PBGD Forward primer (SEQ ID NO: 431):
TGAGAGTGATTCGCGTGGG

PBGD Reverse primer (SEQ ID NO: 432):
CCAGGGTACGAGGCTTTCAAT

PBGD-amplicon (SEQ ID NO: 433):
TGAGAGTGATTCGCGTGGGTACCCGCAAGAGCCAGCTTGCTCGCATACAGACGGACA

GTGTGGTGGCAACATTGAAAGCCTCGTACCCTGG

HPRT1 (GenBank Accession No. NM_000194 (SEQ ID NO: 434)),

HPRT1 Forward primer (SEQ ID NO: 435):
TGACACTGGCAAAACAATGCA

HPRT1 Reverse primer (SEQ ID NO: 436):
GGTCCTTTTCACCAGCAAGCT

HPRT1-amplicon (SEQ ID NO: 437):
TGACACTGGCAAAACAATGCAGACTTTGCTTTCCTTGGTCAGGCAGTATAATCCAAAG

ATGGTCAAGGTCGCAAGCTTGCTGGTGAAAAGGACC

GAPDH (GenBank Accession No. BC026907 (SEQ ID NO: 438))

GAPDH Forward primer (SEQ ID NO: 439):
TGCACCACCAACTGCTTAGC

GAPDH Reverse primer (SEQ ID NO: 440):
CCATCACGCCACAGTTTCC

GAPDH-amplicon (SEQ ID NO: 441):
TGCACCACCAACTGCTTAGCACCCCTGGCCAAGGTCATCCATGACAACTTTGGTATCG

TGGAAGGACTCATGACCACAGTCCATGCCATCACTGCCACCCAGAAGACTGTGGATG

G

The sequences of the housekeeping genes measured in all the examples on colon cancer tissue testing panel were as follows:

PBGD (GenBank Accession No. BC019323 (SEQ ID NO: 430)),

PBGD Forward primer (SEQ ID NO: 431):
TGAGAGTGATTCGCGTGGG

PBGD Reverse primer (SEQ ID NO: 432):
CCAGGGTACGAGGCTTTCAAT

PBGD-amplicon (SEQ ID NO: 433):
TGAGAGTGATTCGCGTGGGTACCCGCAAGAGCCAGCTTGCTCGCATACAGACGGACA

GTGTGGTGGCAACATTGAAAGCCTCGTACCCTGG

HPRT1 (GenBank Accession No. NM_000194 (SEQ ID NO: 434)),

HPRT1 Forward primer (SEQ ID NO: 435):
TGACACTGGCAAAACAATGCA

HPRT1 Reverse primer (SEQ ID NO: 436):
GGTCCTTTTCACCAGCAAGCT

HPRT1-amplicon (SEQ ID NO: 437):
TGACACTGGCAAAACAATGCAGACTTTGCTTTCCTTGGTCAGGCAGTATAATCCAAAG

ATGGTCAAGGTCGCAAGCTTGCTGGTGAAAAGGACC

G6PD (GenBank Accession No. NM_000402 (SEQ ID NO: 442))

G6PD Forward primer (SEQ ID NO: 443):
gaggccgtcaccaagaacat

G6PD Reverse primer (SEQ ID NO: 444):
ggacagccggtcagagctc

G6PD-amplicon (SEQ ID NO: 445):
gaggccgtcaccaagaacattcacgagtcctgcatgagccagataggctggaaccgcatcatcgtggagaagcccttcgggagggacctgc agagctctgaccggctgtcc RPS27A (GenBank Accession No. NM_002954 (SEQ ID NO: 446))

RPS27A Forward primer (SEQ ID NO: 447):
CTGGCAAGCAGCTGGAAGAT

RPS27A Reverse primer (SEQ ID NO: 448):
TTTCTTAGCACCACCACGAAGTC

RPS27A-amplicon (SEQ ID NO: 449):
CTGGCAAGCAGCTGGAAGATGGACGTACTTTGTCTGACTACAATATTCAAAAGGAGT

CTACTCTTCATCTTGTGTTGAGACTTCGTGGTGGTGCTAAGAAA

The sequences of the housekeeping genes measured in all the examples in testing panel were as follows:

```
Ubiquitin (GenBank Accession No. BC000449 (SEQ ID NO: 458))

Ubiquitin Forward primer (SEQ ID NO: 459):
ATTTGGGTCGCGGTTCTTG

Ubiquitin Reverse primer (SEQ ID NO: 460):
TGCCTTGACATTCTCGATGGT

Ubiquitin-amplicon (SEQ ID NO: 461)
ATTTGGGTCGCGGTTCTTGTTTGTGGATCGCTGTGATCGTCACTTGACAATGCAGATCT

TCGTGAAGACTCTGACTGGTAAGACCATCACCCTCGAGG

TTGAGCCCAGTGACACCATCGAGAATGTCAAGGCA

SDHA (GenBank Accession No. NM_004168 (SEQ ID NO: 462))

SDHA Forward primer (SEQ ID NO: 463):
TGGGAACAAGAGGGCATCTG

SDHA Reverse primer (SEQ ID NO: 464):
CCACCACTGCATCAAATTCATG

SDHA-amplicon (SEQ ID NO: 465):
TGGGAACAAGAGGGCATCTGCTAAAGTTTCAGATTCCATTTCTGCTCAGTATCCAGTA

GTGGATCATGAATTTGATGCAGTGGTGG

PBGD (GenBank Accession No. BC019323 (SEQ ID NO: 430)),

PBGD Forward primer (SEQ ID NO: 431):
TGAGAGTGATTCGCGTGGG

PBGD Reverse primer (SEQ ID NO: 432):
CCAGGGTACGAGGCTTTCAAT

PBGD-amplicon (SEQ ID NO: 433):
TGAGAGTGATTCGCGTGGGTACCCGCAAGAGCCAGCTTGCTCGCATACAGACGGACA

GTGTGGTGGCAACATTGAAAGCCTCGTACCCTGG

HPRT1 (GenBank Accession No. NM_000194 (SEQ ID NO: 434)),

HPRT1 Forward primer (SEQ ID NO: 435):
TGACACTGGCAAAACAATGCA

HPRT1 Reverse primer (SEQ ID NO: 436):
GGTCCTTTTCACCAGCAAGCT

HPRT1-amplicon (SEQ ID NO: 437):
TGACACTGGCAAAACAATGCAGACTTTGCTTTCCTTGGTCAGGCAGTATAATCCAAAG

ATGGTCAAGGTCGCAAGCTTGCTGGTGAAAAGGACC
```

The sequences of the housekeeping genes measured in all the examples on breast cancer panel were as follows:

```
G6PD (GeniBank Accession No. NM_000402 (SEQ ID NO: 442))

G6PD Forward primer (SEQ ID NO: 443):
gaggccgtcaccaagaacat

G6PD Reverse primer (SEQ ID NO: 444):
ggacagccggtcagagctc

G6PD-amplicon (SEQ ID NO: 445):
gaggccgtcaccaagaacattcacgagtcctgcatgagccagataggctggaaccgcatcatcgtggagaagcccttcgggagggacctgc agagctctgaccggctgtcc SDHA (GenBank Accession No. NM_004168 (SEQ ID NO: 462))
```

-continued

SDHA Forward primer (SEQ ID NO: 463):
TGGGAACAAGAGGGCATCTG

SDHA Reverse primer (SEQ ID NO: 464):
CCACCACTGCATCAAATTCATG

SDHA-amplicon (SEQ ID NO: 465):
TGGGAACAAGAGGGCATCTGCTAAAGTTTCAGATTCCATTTCTGCTCAGTATCCAGTA

GTGGATCATGAATTTGATGCAGTGGTGG

PBGD (GenBank Accession No. BC019323 (SEQ ID NO: 430)),

PBGD Forward primer (SEQ ID NO: 431):
TGAGAGTGATTCGCGTGGG

PBGD Reverse primer (SEQ ID NO: 432):
CCAGGGTACGAGGCTTTCAAT

PBGD-amplicon (SEQ ID NO: 433):
TGAGAGTGATTCGCGTGGGTACCCGCAAGAGCCAGCTTGCTCGCATACAGACGGACA

GTGTGGTGGCAACATTGAAAGCCTCGTACCCTGG

HPRT1 (GenBank Accession No. NM_000194 (SEQ ID NO: 434)),

HPRT1 Forward primer (SEQ ID NO: 435):
TGACACTGGCAAAACAATGCA

HPRT1 Reverse primer (SEQ ID NO: 436):
GGTCCTTTTCACCAGCAAGCT

HPRT1-amplicon (SEQ ID NO: 437):
TGACACTGGCAAAACAATGCAGACTTTGCTTTCCTTGGTCAGGCAGTATAATCCAAAG

ATGGTCAAGGTCGCAAGCTTGCTGGTGAAAAGGACC

The sequences of the housekeeping genes measured in all the examples on normal tissue samples panel were as follows:

RPL19 (GenBank Accession No. NM_000981 (SEQ ID NO: 450)

RPL19Forward primer (SEQ ID NO: 451):
TGGCAAGAAGAAGGTCTGGTTAG

RPL19Reverse primer (SEQ ID NO: 452):
TGATCAGCCCATCTTTGATGAG

RPL19-amplicon (SEQ ID NO: 453):
TGGCAAGAAGAAGGTCTGGTTAGACCCCAATGAGACCAATGAAATCGCCAATGCCAA

CTCCCGTCAGCAGATCCGGAAGCTCATCAAAGATGGGCTGATCA

TATA box (GenBank Accession No. NM_003194 (SEQ ID NO: 454)),

TATA box Forward primer (SEQ ID NO: 455):
CGGTTTGCTGCGGTAATCAT

TATA box Reverse primer (SEQ ID NO: 456):
TTTCTTGCTGCCAGTCTGGAC

TATA box amplicon (SEQ ID NO: 457):
CGGTTTGCTGCGGTAATCATGAGGATAAGAGAGCCACGAACCACGGCACTGATTTTC

AGTTCTGGGAAAATGGTGTGCACAGGAGCCAAGAGTGAAGAACAGTCCAGACTGGCA

GCAAGAAA

Ubiquitin (GenBank Accession No. BC000449 (SEQ ID NO: 458))

Ubiquitin Forward primer (SEQ ID NO: 459):
ATTTGGGTCGCGGTTCTTG

Ubiquitin Reverse primer (SEQ ID NO: 460):
TGCCTTGACATTCTCGATGGT

```
Ubiquitin-amplicon (SEQ ID NO: 461)
ATTTGGGTCGCGGTTCTTGTTTGTGGATCGCTGTGATCGTCACTTGACAATGCAGATCT

TCGTGAAGACTCTGACTGGTAAGACCATCACCCTCGAGG

TTGAGCCCAGTGACACCATCGAGAATGTCAAGGCA

SDHA (GenBank Accession No. NM_004168 (SEQ ID NO: 462))

SDHA Forward primer (SEQ ID NO: 463):
TGGGAACAAGAGGGCATCTG

SDHA Reverse primer (SEQ ID NO: 464):
CCACCACTGCATCAAATTCATG

SDHA-amplicon (SEQ ID NO: 465):
TGGGAACAAGAGGGCATCTGCTAAAGTTTCAGATTCCATTTCTGCTCAGTATCCAGTA

GTGGATCATGAATTTGATGCAGTGGTGG
```

The following examples relate to specific actual marker examples. The following table, Table 3, describes the membranal marker examples of the present invention, which can be used as biomarkers for in vivo imaging, as described with regard to the "Background" section given above. The following Table 4, describes additional marker examples of the present invention, which can be used as diagnostic markers, preferably as serum markers, optionally as immunoassay markers, as described with regard to the "Background" section given above.

TABLE 3

Membranal biomarkers:

| Contig name | Protein number | Localization |
|---|---|---|
| HSI6REC | HSI6REC_P1 (SEQ ID NO: 24) | membrane |
| HSI6REC | HSI6REC_P2 (SEQ ID NO: 25) | membrane |
| HSU40434 | HSU40434_P11 (SEQ ID NO: 81) | membrane |
| HSU40434 | HSU40434_P14 (SEQ ID NO: 82) | membrane |
| HSU40434 | HSU40434_P18 (SEQ ID NO: 84) | membrane |
| HSU40434 | HSU40434_P16 (SEQ ID NO: 83) | membrane |
| HUMIL1RA | HUMIL1RA_P3 | membrane |
| M62246 | M62246_1_P9 (SEQ ID NO: 111) | membrane |
| M62246 | M62246_1_P15 (SEQ ID NO: 114) | intracellular |
| M62246 | M62246_1_P13 (SEQ ID NO: 113) | intracellular |
| M62246 | M62246_1_P12 (SEQ ID NO: 112) | membrane |
| M78076 | M78076_P6 (SEQ ID NO: 170) | membrane |
| M78076 | M78076_P16 (SEQ ID NO: 173) | membrane |
| M78076 | M78076_P25 (SEQ ID NO: 177) | membrane |
| HSUPARAA | HSUPARAA_P7 (SEQ ID NO: 228) | membrane |
| HSUPARAA | HSUPARAA_P16 (SEQ ID NO: 234) | membrane |
| HSUPARAA | HSUPARAA_P8 (SEQ ID NO: 229) | membrane |
| HSUPARAA | HSUPARAA_P14 (SEQ ID NO: 232) | membrane |
| T27396_PEA_1 | T27396_PEA_1_P3 (SEQ ID NO: 339) | membrane |
| T27396_PEA_1 | T27396_PEA_1_P4 (SEQ ID NO: 340) | membrane |
| T27396_PEA_1 | T27396_PEA_1_P10 (SEQ ID NO: 341) | membrane |
| T27396_PEA_1 | T27396_PEA_1_P12 (SEQ ID NO: 342) | membrane |
| T27396_PEA_1 | T27396_PEA_1_P13 (SEQ ID NO: 343) | membrane |
| T27396_PEA_1 | T27396_PEA_1_P14 (SEQ ID NO: 344) | membrane |
| T27396_PEA_1 | T27396_PEA_1_P18 (SEQ ID NO: 345) | membrane |
| T27396_PEA_1 | T27396_PEA_1_P24 (SEQ ID NO: 346) | intracellular |
| T27396_PEA_1 | T27396_PEA_1_P26 (SEQ ID NO: 347) | membrane |
| T27396_PEA_1 | T27396_PEA_1_P27 (SEQ ID NO: 348) | intracellular |
| T27396_PEA_1 | T27396_PEA_1_P30 (SEQ ID NO: 349) | membrane |
| T51958 | T51958_P13 (SEQ ID NO: 425) | membrane |

TABLE 4

Secreted biomarkers:

| Contig name | Transcript number | Localization |
|---|---|---|
| HSI6REC | HSI6REC_P5 (SEQ ID NO: 27) | secreted |
| HSI6REC | HSI6REC_P4 (SEQ ID NO: 26) | secreted |
| HSI6REC | HSI6REC_P6 (SEQ ID NO: 28) | secreted |
| HSU40434 | HSU40434_P7 (SEQ ID NO: 80) | secreted |
| M78076 | M78076_P5 (SEQ ID NO: 169) | secreted |
| M78076 | M78076_P7 (SEQ ID NO: 171) | secreted |
| M78076 | M78076_P17 (SEQ ID NO: 174) | secreted |
| M78076 | M78076_P11 (SEQ ID NO: 172) | secreted |
| M78076 | M78076_P22 (SEQ ID NO: 175) | secreted |
| M78076 | M78076_P23 (SEQ ID NO: 176) | secreted |
| HSUPARAA | HSUPARAA_P1 (SEQ ID NO: 226) | secreted |
| HSUPARAA | HSUPARAA_P2 (SEQ ID NO: 227) | secreted |
| HSUPARAA | HSUPARAA_P11 (SEQ ID NO: 230) | secreted |
| HSUPARAA | HSUPARAA_P13 (SEQ ID NO: 231) | secreted |
| HSUPARAA | HSUPARAA_P15 (SEQ ID NO: 233) | secreted |
| HSUPARAA | HSUPARAA_P20 (SEQ ID NO: 235) | secreted |
| HSUPARAA | HSUPARAA_P26 (SEQ ID NO: 236) | secreted |
| HSUPARAA | HSUPARAA_P27 (SEQ ID NO: 237) | secreted |
| R11723 | R11723_1_P9 (SEQ ID NO: 276) | secreted |
| R11723 | R11723_1_P13 (SEQ ID NO: 277) | secreted |
| R11723 | R11723_1_P14 (SEQ ID NO: 278) | secreted |
| R11723 | R11723_1_P15 (SEQ ID NO: 279) | secreted |
| R11723 | R11723_1_P16 (SEQ ID NO: 280) | secreted |
| R11723 | R11723_1_P19 (SEQ ID NO: 281) | secreted |
| T51958 | T51958_P1 (SEQ ID NO: 423) | secreted |
| T51958 | T51958_P8 (SEQ ID NO: 424) | secreted |
| T51958 | T51958_P27 (SEQ ID NO: 426) | secreted |
| T51958 | T51958_P29 (SEQ ID NO: 427) | secreted |
| T51958 | T51958_P60 (SEQ ID NO: 429) | secreted |
| T51958 | T51958_P59 (SEQ ID NO: 428) | secreted |

Description for Cluster HSI6REC

Cluster HSI6REC features 6 transcript(s) and 13 segment(s) of interest, the names for which are given in Tables 5 and 6, respectively, the sequences themselves are given at the end of the application. The selected protein variants are given in table 7.

TABLE 5

Transcripts of interest
Transcript Name

HSI6REC_T1 (SEQ ID NO: 1)
HSI6REC_T2 (SEQ ID NO: 2)
HSI6REC_T4 (SEQ ID NO: 3)
HSI6REC_T5 (SEQ ID NO: 4)

TABLE 5-continued

Transcripts of interest
Transcript Name

HSI6REC_T6 (SEQ ID NO: 5)
HSI6REC_T7 (SEQ ID NO: 6)

TABLE 6

Segments of interest
Segment Name

HSI6REC_N0 (SEQ ID NO: 7)
HSI6REC_N2 (SEQ ID NO: 8)
HSI6REC_N4 (SEQ ID NO: 9)
HSI6REC_N6 (SEQ ID NO: 10)
HSI6REC_N8 (SEQ ID NO: 11)
HSI6REC_N10 (SEQ ID NO: 12)
HSI6REC_N12 (SEQ ID NO: 13)
HSI6REC_N25 (SEQ ID NO: 14)
HSI6REC_N14 (SEQ ID NO: 15)
HSI6REC_N16 (SEQ ID NO: 16)
HSI6REC_N18 (SEQ ID NO: 17)
HSI6REC_N20 (SEQ ID NO: 18)
HSI6REC_N23 (SEQ ID NO: 19)

TABLE 7

Proteins of interest

| Protein Name | Corresponding Transcript(s) |
| --- | --- |
| HSI6REC_P1 (SEQ ID NO: 24) | HSI6REC_T1 (SEQ ID NO: 1) |
| HSI6REC_P2 (SEQ ID NO: 25) | HSI6REC_T2 (SEQ ID NO: 2) |
| HSI6REC_P4 (SEQ ID NO: 26) | HSI6REC_T4 (SEQ ID NO: 3) |
| HSI6REC_P5 (SEQ ID NO: 27) | HSI6REC_T5 (SEQ ID NO: 4) |
| HSI6REC_P6 (SEQ ID NO: 28) | HSI6REC_T6 (SEQ ID NO: 5); HSI6REC_T7 (SEQ ID NO: 6) |

These sequences are variants of the known protein Interleukin-6 receptor alpha chain precursor (SEQ ID NO:20) (SwissProt accession identifier IL6RA_HUMAN (SEQ ID NO:590); known also according to the synonyms IL-6R-alpha; IL-6R 1; CD126 antigen), referred to herein as the previously known protein.

Protein Interleukin-6 receptor alpha chain precursor (SEQ ID NO:20) is known or believed to have the following function(s): Part of the receptor for interleukin 6. Binds to IL-6 with low affinity, but does not transduce a signal. Signal activation necessitate an association with IL6ST. Activation may lead to the regulation of the immune response, acute-phase reactions and hematopoiesis. Low concentration of a soluble form of interleukin-6 receptor acts as an agonist of IL6 activity. The sequence for protein Interleukin-6 receptor alpha chain precursor (SEQ ID NO:20) is given at the end of the application, as "Interleukin-6 receptor alpha chain precursor (SEQ ID NO:20) amino acid sequence". Protein Interleukin-6 receptor alpha chain precursor (SEQ ID NO:20) localization is believed to be Type I membrane protein (isoform 1) Secreted (isoform 2).

The previously known protein also has the following indication(s) and/or potential therapeutic use(s): Hepatic dysfunction, general; Unspecified. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Interleukin 2 agonist; Interleukin 6 agonist; Interleukin 6 antagonist; Interleukin 6 receptor antagonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anti-inflammatory; Antianaemic; Antiarthritic, immunological; Anticancer, immunological; Anticancer, interferon; Anticancer, other; Antiviral, interferon; Cytokine; GI inflammatory/bowel disorders; Haematological; Hepatoprotective; Immunosuppressant; Monoclonal antibody, humanized; Radio/chemoprotective; Recombinant interleukin; Recombinant, other.

The following GO Annotation(s) apply to the previously known protein. The following annotation(s) were found: cell proliferation; cell surface receptor linked signal transduction; development; immune response, which are annotation(s) related to Biological Process; enzyme binding; interleukin-6 receptor activity, which are annotation(s) related to Molecular Function; and extracellular region; interleukin-6 receptor complex, which are annotation(s) related to Cellular Component.

The GO assignment relies on information from one or more of the SwissProt/TremB 1 Protein knowledgebase, available from <. expasy.ch/sprot/>; or Locuslink, available from <.ncbi .nlm.nih.gov/projects/LocusLinkl>.

As noted above, cluster HSI6REC features 6 transcript(s), which were listed in Table 5 above. These transcript(s) encode for protein(s) which are variant(s) of protein Interleukin-6 receptor alpha chain precursor (SEQ ID NO:20). A description of each variant protein according to the present invention is now provided.

Variant protein HSI6REC_P1 (SEQ ID NO:24) according to the present invention has an amino acid sequence as given at the end of the application; it is encoded by transcript(s) HSI6REC_T1 (SEQ ID NO:1). An alignment is given to the known protein (Interleukin-6 receptor alpha chain precursor (SEQ ID NO:20)) at the end of the application. One or more alignments to one or more previously published protein sequences are given at the end of the application. A brief description of the relationship of the variant protein according to the present invention to each such aligned protein is as follows:

1. Comparison Report Between HSI6REC_P1 (SEQ ID NO:24) and IL6RA_HUMAN (SEQ ID NO:590):

A. An isolated chimeric polypeptide encoding for HSI6REC_P1 (SEQ ID NO:24), comprising a first amino acid sequence being at least 90% homologous to MLAVG-CALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWT corresponding to amino acids 1-316 of IL6RA_HUMAN (SEQ ID NO:590), which also corresponds to amino acids 1-316 of HSI6REC_P1 (SEQ ID NO:24), a second amino acid sequence being at least 70%, optionally at least 80%, preferably at least 85%, more preferably at least 90% and most preferably at least 95% homologous to a polypeptide having the sequence EMRSHY- VTQAGFKLLASWDSPASVSQSAGIT (SEQ ID NO:518) corresponding to amino acids 317-347 of HSI6REC_P1 (SEQ ID NO:24), and a third amino acid sequence being at least 90% homologous to ESRSPPAENEVSTPMQALTTNKDDDNILFRDSANATSLPVQDSSSVPLPTFLVAGGSLAFG TLLCIAIVLRFKKTWKLRALKEGKTSMHPPYSLGQLVPERPRPTPVLVPLISPPV SPSSLGS DNTSSHNRPDARDPRSPYDISNTDYFFPR corresponding to amino acids 317-468 of IL6RA_HUMAN (SEQ ID NO:590), which also corresponds to amino acids 348-499 of HSI6REC_P1 (SEQ ID NO:24), wherein said first amino acid sequence, second amino acid sequence and third amino acid sequence are contiguous and in a sequential order.

B. An isolated polypeptide encoding for an edge portion of HSI6REC_P1 (SEQ ID NO:24), comprising an amino acid sequence being at least 70%, optionally at least about 80%, preferably at least about 85%, more preferably at least about 90% and most preferably at least about 95% homologous to the sequence EMRSHYVTQAGFKLLASWDSPASVSQSAGIT (SEQ ID NO:518) of HSI6REC_P1 (SEQ ID NO:24).

2. Comparison Report Between HSI6REC_P1 (SEQ ID NO:24) and NP_000556 (SEQ ID NO:21):

A. An isolated chimeric polypeptide encoding for HSI6REC_P1 (SEQ ID NO:24), comprising a first amino acid sequence being at least 90% homologous to MLAVGCALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWT corresponding to amino acids 1-316 of NP_000556 (SEQ ID NO:21), which also corresponds to amino acids 1-316 of HSI6REC_P1 (SEQ ID NO:24), a second amino acid sequence being at least 70%, optionally at least 80%, preferably at least 85%, more preferably at least 90% and most preferably at least 95% homologous to a polypeptide having the sequence EMRSHY-VTQAGFKLLASWDSPASVSQSAGIT (SEQ ID NO:518) corresponding to amino acids 317-347 of HSI6REC_P1 (SEQ ID NO:24), and a third amino acid sequence being at least 90% homologous to ESRSPPAENEVSTPMQALTT-NKDDDNILFRDSANATSLPVQDSSSV-PLPTFLVAGGSLAFG TLLCIAIVLRFKKTWKL-RALKEGKTSMHPPYSLGQLVPERPRPTPVLVPLISPPV SPSSLGS DNTSSHNRPDARDPRSPYDISNTDYFFPR corresponding to amino acids 317-468 of NP_000556 (SEQ ID NO:21), which also corresponds to amino acids 348-499 of HSI6REC_P1 (SEQ ID NO:24), wherein said first amino acid sequence, second amino acid sequence and third amino acid sequence are contiguous and in a sequential order.

B. An isolated polypeptide encoding for an edge portion of HSI6REC_P1 (SEQ ID NO:24), comprising an amino acid sequence being at least 70%, optionally at least about 80%, preferably at least about 85%, more preferably at least about 90% and most preferably at least about 95% homologous to the sequence EMRSHYVTQAGFKLLASWDSPAS-VSQSAGIT (SEQ iID NO:518) of HSI6REC_P1 (SEQ ID NO:24).

3. Comparison Report Between HSI6REC_P1 (SEQ ID NO:24) and P08887-2 (SEQ ID NO:22):

A. An isolated chimeric polypeptide encoding for HSI6REC_P1 (SEQ ID NO:24), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWT corresponding to amino acids 1-316 of P08887-2 (SEQ ID NO:22), which also corresponds to amino acids 1-316 of HSI6REC_P1 (SEQ ID NO:24), a second amino acid sequence being at least 70%, optionally at least 80%, preferably at least 85%, more preferably at least 90% and most preferably at least 95% homologous to a polypeptide having the sequence EMRSHY-VTQAGFKLLASWDSPASVSQSAGIT (SEQ ID NO:518) corresponding to amino acids 317-347 of HSI6REC_P1 (SEQ ID NO:24), a third amino acid sequence being at least 90% homologous to ESRSPPAENEVSTPMQALTTNKD-DDNILFRDSANATSLP corresponding to amino acids 317-355 of P08887-2 (SEQ ID NO:22), which also corresponds to amino acids 348-386 of HSI6REC_P1 (SEQ ID NO:24), and a fourth amino acid sequence being at least 70%, optionally at least 80%, preferably at least 85%, more preferably at least 90% and most preferably at least 95% homologous to a polypeptide having the sequence VQDSSSVPLPT-FLVAGGSLAFGTLLCIAIVLRFKKTWKL-RALKEGKTSMHPPYSLGQLVPE RPRPTPVLVPLISP-PVSPSSLGSDNTSSHNRPDARDPRSPYDISNTDYFFPR (SEQ ID NO:519) corresponding to amino acids 387-499 of HSI6REC_P1 (SEQ ID NO:24), wherein said first amino acid sequence, second amino acid sequence, third amino acid sequence and fourth amino acid sequence are contiguous and in a sequential order.

B. An isolated polypeptide encoding for an edge portion of HSI6REC_P1 (SEQ ID NO:24), comprising an amino acid sequence being at least 70%, optionally at least about 80%, preferably at least about 85%, more preferably at least about 90% and most preferably at least about 95% homologous to the sequence EMRSHYVTQAGFKLLASWDSPAS-VSQSAGIT (SEQ ID NO:518) of HSI6REC_P1 (SEQ ID NO:24).

C. An isolated polypeptide encoding for an edge portion of HSI6REC_P1 (SEQ ID NO:24), comprising an amino acid sequence being at least 70%, optionally at least about 80%, preferably at least about 85%, more preferably at least about 90% and most preferably at least about 95% homologous to the sequence VQDSSSVPLPTFLVAGGSLAFGTLLCI-AIVLRFKKTWKLRALKEGKTSMHPPYSLGQLVPE RPRPTPVLVPLISPPVSPSSLGS-DNTSSHNRPDARDPRSPYDISNTDYFFPR (SEQ ID NO:519) of HSI6REC_P1 (SEQ ID NO:24).

4. Comparison Report Between HSI6REC_P1 (SEQ ID NO:24) and NP_852004 (SEQ ID NO:23):

A. An isolated chimeric polypeptide encoding for HSI6REC_P1 (SEQ ID NO:24), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWT corresponding to amino acids 1-316 of NP_852004 (SEQ ID NO:23), which also corresponds to amino acids 1-316 of HSI6REC_P1 (SEQ ID NO:24), a second amino acid sequence being at least 70%, optionally at least 80%, preferably at least 85%, more preferably at least 90% and most preferably at least 95% homologous to a polypeptide having the sequence EMRSHYVTQAGFKLLASWDSPASVSQSAGIT (SEQ ID NO:518) corresponding to amino acids 317-347 of HSI6REC_P1 (SEQ ID NO:24), a third amino acid sequence being at least 90% homologous to ESRSPPAENEVSTPMQALTTNKD-DDNILFRDSANATSLP corresponding to amino acids 317-355 of NP_852004 (SEQ ID NO:23), which also corresponds to amino acids 348-386 of HSI6REC_P1 (SEQ ID NO:24), and a fourth amino acid sequence being at least 70%, optionally at least 80%, preferably at least 85%, more preferably at least 90% and most preferably at least 95% homologous to a polypeptide having the sequence VQDSSSVPLPT-FLVAGGSLAFGTLLCIAIVLRFKKTWKLRALKEGKTS MHPPYSLGQLVPE RPRPTPVLVPLISPPVSPSSLGS-DNTSSHNRPDARDPRSPYDISNTDYFFPR (SEQ ID NO:519) corresponding to amino acids 387-499 of HSI6REC_P1 (SEQ ID NO:24), wherein said first amino acid sequence, second amino acid sequence, third amino acid sequence and fourth amino acid sequence are contiguous and in a sequential order.

B. An isolated polypeptide encoding for an edge portion of HSI6REC_P1 (SEQ ID NO:24), comprising an amino acid sequence being at least 70%, optionally at least about 80%, preferably at least about 85%, more preferably at least about 90% and most preferably at least about 95% homologous to the sequence EMRSHYVTQAGFKLLASWDSPAS-VSQSAGIT (SEQ ID NO:518) of HSI6REC_P 1 (SEQ ID NO:24).

C. An isolated polypeptide encoding for an edge portion of HSI6REC_P1 (SEQ ID NO:24), comprising an amino acid sequence being at least 70%, optionally at least about 80%, preferably at least about 85%, more preferably at least about 90% and most preferably at least about 95% homologous to the sequence VQDSSSVPLPTFLVAGGSLAFGTLLCI-AIVLRFKKTWKLRALKEGKTSMHPPYSLGQLVPE RPRPTPVLVPLISPPVSPSSLGS-DNTSSHNRPDARDPRSPYDISNTDYFFPR (SEQ ID NO:519) of HSI6REC_P1 (SEQ ID NO:24).

The localization of the variant protein was determined according to results from a number of different software programs and analyses, including analyses from SignalP and other specialized programs. The variant protein is believed to be located as follows with regard to the cell: membrane.

Variant protein HSI6REC_P1 (SEQ ID NO:24) also has the following non-silent SNPs (Single Nucleotide Polymorphisms) as listed in Table 8, (given according to their position(s) on the amino acid sequence, with the alternative amino acid(s) listed; the last column indicates whether the SNP is known or not; the presence of known SNPs in variant protein HSI6REC_P1 (SEQ ID NO:24) sequence provides support for the deduced sequence of this variant protein according to the present invention).

TABLE 8

Amino acid mutations

| SNP position(s) on amino acid sequence | Alternative amino acid(s) | Previously known SNP? |
| --- | --- | --- |
| 81 | L -> R | Yes |
| 136 | P -> S | Yes |
| 389 | D -> A | Yes |

The glycosylation sites of variant protein HSI6REC_P1 (SEQ ID NO:24), as compared to the known protein Interleukin-6 receptor alpha chain precursor (SEQ ID NO:20), are described in Table 9 (given according to their position(s) on the amino acid sequence in the first column; the second column indicates whether the glycosylation site is present in the variant protein; and the last column indicates whether the position is different on the variant protein).

TABLE 9

Glycosylation site(s)

| Position(s) on known amino acid sequence | Present in variant protein? | Position(s) on variant protein |
| --- | --- | --- |
| 55 | Yes | 55 |
| 93 | Yes | 93 |
| 221 | Yes | 221 |
| 245 | Yes | 245 |

The variant protein has the following domains, as determined by using InterPro. The domains are described in Table 10:

TABLE 10

InterPro domain(s)

| Domain description | Analysis type | Position(s) on protein |
| --- | --- | --- |
| Fibronectin, type III | HMMPfam | 216-304 |
| Immunoglobulin-like | HMMPfam | 40-98 |
| Fibronectin, type III | HMMSmart | 216-301 |
| Immunoglobulin C2 type | HMMSmart | 38-103 |
| Immunoglobulin subtype | HMMSmart | 32-111 |
| Cytokine receptor, common beta | ProfileScan | 115-216 |
| Immunoglobulin-like | ProfileScan | 26-96 |
| Long hematopoietin receptor, soluble alpha chain | ScanRegExp | 214-255 |

Variant protein HSI6REC_P1 (SEQ ID NO:24) is encoded by the following transcript(s): HSI6REC_T1 (SEQ ID NO:1), for which the sequence(s) is/are given at the end of the application. The coding portion of transcript HS16REC_T1 (SEQ ID NO:1) is shown in bold; this coding portion starts at position 438 and ends at position 1934. The transcript also has the following SNPs as listed in Table 11 (given according to their position on the nucleotide sequence, with the alternative nucleic acid listed; the last column indicates whether the SNP is known or not; the presence of known SNPs in variant protein HSI6REC_P1 (SEQ ID NO:24) sequence provides support for the deduced sequence of this variant protein according to the present invention).

TABLE 11

Nucleic acid SNPs

| SNP position(s) on nucleotide sequence | Alternative nucleic acid(s) | Previously known SNP? |
|---|---|---|
| 230 | G -> A | Yes |
| 488 | A -> G | No |
| 530 | G -> A | Yes |
| 647 | C -> T | Yes |
| 679 | T -> G | Yes |
| 843 | C -> T | Yes |
| 1603 | A -> C | Yes |
| 1922 | C -> T | Yes |
| 1977 | C -> T | Yes |
| 2165 | T -> C | Yes |
| 2961 | C -> T | Yes |
| 3946 | A -> T | Yes |
| 4472 | T -> C | Yes |
| 5252 | C -> | No |
| 5565 | G -> A | Yes |
| 5938 | T -> | Yes |
| 5946 | T -> | No |

Variant protein HSI6REC_P2 (SEQ ID NO:25) according to the present invention has an amino acid sequence as given at the end of the application; it is encoded by transcript(s) HSI6REC_T2 (SEQ ID NO:2). An alignment is given to the known protein (Interleukin-6 receptor alpha chain precursor (SEQ ID NO:20)) at the end of the application. One or more alignments to one or more previously published protein sequences are given at the end of the application. A brief description of the relationship of the variant protein according to the present invention to each such aligned protein is as follows:

1. Comparison Report Between HSI6REC_P2 (SEQ ID NO:25) and IL6RA_HUMAN (SEQ ID NO:590):

A. An isolated chimeric polypeptide encoding for HSI6REC_P2 (SEQ ID NO:25), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWT corresponding to amino acids 1-316 of IL6RA_HUMAN (SEQ ID NO:590), which also corresponds to amino acids 1-316 of HSI6REC_P2 (SEQ ID NO:25), a second amino acid sequence being at least 70%, optionally at least 80%, preferably at least 85%, more preferably at least 90% and most preferably at least 95% homologous to a polypeptide having the sequence GFSPQTIPGGI-WDPAG (SEQ ID NO:520) corresponding to amino acids 317-332 of HSI6REC_P2 (SEQ ID NO:25), and a third amino acid sequence being at least 90% homologous to ESRSP-PAENEVSTPMQALTTNKDDDNILFRD-SANATSLPVQDSSSVPLPTFLVAGGSLAFG TLLCIAIV-LRFKKTWKLRALKEGKTSMHPPYSLGQLVPERPRPT PVLVPLISPPVSPSSLGS DNTSSHNRPDARDPRSPY-DISNTDYFFPR corresponding to amino acids 317-468 of IL6RA_HUMAN (SEQ ID NO:590), which also corresponds to amino acids 333-484 of HSI6REC_P2 (SEQ ID NO:25), wherein said first amino acid sequence, second amino acid sequence and third amino acid sequence are contiguous and in a sequential order.

B. An isolated polypeptide encoding for an edge portion of HSI6REC_P2 (SEQ ID NO:25), comprising an amino acid sequence being at least 70%, optionally at least about 80%, preferably at least about 85%, more preferably at least about 90% and most preferably at least about 95% homologous to the sequence GFSPQTIPGGIWDPAG (SEQ ID NO:520) of HSI6REC_P2 (SEQ ID NO:25).

2. Comparison Report Between HSI6REC_P2 (SEQ ID NO:25) and NP_000556 (SEQ ID NO:21):

A. An isolated chimeric polypeptide encoding for HSI6REC_P2 (SEQ ID NO:25), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWT corresponding to amino acids 1-316 of NP_000556 (SEQ ID NO:21), which also corresponds to amino acids 1-316 of HSI6REC_P2 (SEQ ID NO:25), a second amino acid sequence being at least 70%, optionally at least 80%, preferably at least 85%, more preferably at least 90% and most preferably at least 95% homologous to a polypeptide having the sequence GFSPQTIPGGI-WDPAG (SEQ ID NO:520) corresponding to amino acids 317-332 of HSI6REC_P2 (SEQ ID NO:25), and a third amino acid sequence being at least 90% homologous to ESRSP-PAENEVSTPMQALTTNKDDDNILFRD-SANATSLPVQDSSSVPLPTFLVAGGSLAFG TLLCIAIV-LRFKKTWKLRALKEGKTSMHPPYSLGQLVPERPRPTP VLVPLISPPVSPSSLGS DNTSSHNRPDARDPRSPY-DISNTDYFFPR corresponding to amino acids 317-468 of NP_000556 (SEQ ID NO:21), which also corresponds to amino acids 333-484 of HSI6REC_P2 (SEQ ID NO:25), wherein said first amino acid sequence, second amino acid sequence and third amino acid sequence are contiguous and in a sequential order.

B. An isolated polypeptide encoding for an edge portion of HSI6REC_P2 (SEQ ID NO:25), comprising an amino acid sequence being at least 70%, optionally at least about 80%, preferably at least about 85%, more preferably at least about 90% and most preferably at least about 95% homologous to the sequence GFSPQTIPGGIWDPAG (SEQ ID NO:520) of HSI6REC_P2 (SEQ ID NO:25).

3. Comparison Report Between HSI6REC_P2 (SEQ ID NO:25) and P08887-2 (SEQ ID NO:22):

A. An isolated chimeric polypeptide encoding for HSI6REC_P2 (SEQ ID NO:25), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWT corresponding to amino acids 1-316 of P08887-2 (SEQ ID NO:22), which also corresponds to amino acids 1-316 of HSI6REC_P2 (SEQ ID NO:25), a second amino acid sequence being at least 70%, optionally at least 80%, preferably at least 85%, more preferably at least 90% and most preferably at least 95% homologous to a polypeptide having the sequence GFSPQTIPGGI-WDPAG (SEQ ID NO:520) corresponding to amino acids 317-332 of HSI6REC_P2 (SEQ ID NO:25), a third amino acid sequence being at least 90% homologous to ESRSP-PAENEVSTPMQALTTNKDDDNILFRDSANATSLP corresponding to amino acids 317-355 of P08887-2 (SEQ ID NO:22), which also corresponds to amino acids 333-371 of HSI6REC_P2 (SEQ ID NO:25), and a fourth amino acid sequence being at least 70%, optionally at least 80%, preferably at least 85%, more preferably at least 90% and most preferably at least 95% homologous to a polypeptide having the sequence VQDSSSVPLPTFLVAGGSLAFGTLLCI-AIVLRFKKTWKLRALKEGKTSMHPPYSLGQLVPE RPRPTPVLVPLISPPVSPSSLGS-DNTSSHNRPDARDPRSPYDISNTDYFFPR (SEQ ID NO:519) corresponding to amino acids 372-484 of HSI6REC_P2 (SEQ ID NO:25), wherein said first amino acid sequence, second amino acid sequence, third amino acid sequence and fourth amino acid sequence are contiguous and in a sequential order.

B. An isolated polypeptide encoding for an edge portion of HSI6REC_P2 (SEQ ID NO:25), comprising an amino acid sequence being at least 70%, optionally at least about 80%, preferably at least about 85%, more preferably at least about 90% and most preferably at least about 95% homologous to the sequence GFSPQTIPGGIWDPAG (SEQ ID NO:520) of HSI6REC_P2 (SEQ ID NO:25).

C. An isolated polypeptide encoding for an edge portion of HSI6REC_P2 (SEQ ID NO:25), comprising an amino acid sequence being at least 70%, optionally at least about 80%, preferably at least about 85%, more preferably at least about 90% and most preferably at least about 95% homologous to the sequence VQDSSSVPLPTFLVAGGSLAFGTLLCI-AIVLRFKKTWKLRALKEGKTSMHPPYSLGQLVPE RPRPTPVLVPLISPPVSPSSLGS-DNTSSHNRPDARDPRSPYDISNTDYFFPR (SEQ ID NO:519) of HSI6REC_P2 (SEQ ID NO:25).

4. Comparison Report Between HSI6REC_P2 (SEQ ID NO:25) and NP_852004 (SEQ ID NO:23):

A. An isolated chimeric polypeptide encoding for HSI6REC_P2 (SEQ ID NO:25), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWT corresponding to amino acids 1-316 of NP_852004 (SEQ ID NO:23), which also corresponds to amino acids 1-316 of HSI6REC_P2 (SEQ ID NO:25), a second amino acid sequence being at least 70%, optionally at least 80%, preferably at least 85%, more preferably at least 90% and most preferably at least 95% homologous to a polypeptide having the sequence GFSPQTIPGGI-WDPAG (SEQ ID NO:520) corresponding to amino acids 317-332 of HSI6REC_P2 (SEQ ID NO:25), a third amino acid sequence being at least 90% homologous to ESRSP-PAENEVSTPMQALTTNKDDDNILFRDSANATSLP corresponding to amino acids 317-355 of NP_852004 (SEQ ID NO:23), which also corresponds to amino acids 333-371 of HSI6REC_P2 (SEQ ID NO:25), and a fourth amino acid sequence being at least 70%, optionally at least 80%, preferably at least 85%, more preferably at least 90% and most preferably at least 95% homologous to a polypeptide having the sequence VQDSSSVPLPTFLVAGGSLAFGTLLCI-AIVLRFKKTWKLRALKEGKTSMHPPYSLGQLVPE RPRPTPVLVPLISPPVSPSSLGS-DNTSSHNRPDARDPRSPYDISNTDYFFPR (SEQ ID NO:519) corresponding to amino acids 372-484 of HSI6REC_P2 (SEQ ID NO:25), wherein said first amino acid sequence, second amino acid sequence, third amino acid sequence and fourth amino acid sequence are contiguous and in a sequential order.

B. An isolated polypeptide encoding for an edge portion of HSI6REC_P2 (SEQ ID NO:25), comprising an amino acid sequence being at least 70%, optionally at least about 80%, preferably at least about 85%, more preferably at least about 90% and most preferably at least about 95% homologous to the sequence GFSPQTIPGGIWDPAG (SEQ ID NO:520) of HSI6REC_P2 (SEQ ID NO:25).

C. An isolated polypeptide encoding for an edge portion of HSI6REC_P2 (SEQ ID NO:25), comprising an amino acid sequence being at least 70%, optionally at least about 80%, preferably at least about 85%, more preferably at least about 90% and most preferably at least about 95% homologous to the sequence VQDSSSVPLPTFLVAGGSLAFGTLLCI-AIVLRFKKTWKLRALKEGKTSMHPPYSLGQLVPE RPRPTPVLVPLISPPVSPSSLGS-DNTSSHNRPDARDPRSPYDISNTDYFFPR (SEQ ID NO:519) of HSI6REC_P2 (SEQ ID NO:25).

The localization of the variant protein was determined according to results from a number of different software programs and analyses, including analyses from SignalP and other specialized programs. The variant protein is believed to be located as follows with regard to the cell: membrane.

Variant protein HSI6REC_P2 (SEQ ID NO:25) also has the following non-silent SNPs (Single Nucleotide Polymorphisms) as listed in Table 12, (given according to their position(s) on the amino acid sequence, with the alternative amino acid(s) listed; the last column indicates whether the SNP is known or not; the presence of known SNPs in variant protein HSI6REC_P2 (SEQ ID NO:25) sequence provides support for the deduced sequence of this variant protein according to the present invention).

TABLE 12

Amino acid mutations

| SNP position(s) on amino acid sequence | Alternative amino acid(s) | Previously known SNP? |
|---|---|---|
| 81 | L -> R | Yes |
| 136 | P -> S | Yes |
| 374 | D -> A | Yes |

The glycosylation sites of variant protein HSI6REC_P2 (SEQ ID NO:25), as compared to the known protein Interleukin-6 receptor alpha chain precursor (SEQ ID NO:20), are described in Table 13 (given according to their position(s) on the amino acid sequence in the first column; the second column indicates whether the glycosylation site is present in the variant protein; and the last column indicates whether the position is different on the variant protein).

TABLE 13

Glycosylation site(s)

| Position(s) on known amino acid sequence | Present in variant protein? | Position(s) on variant protein |
|---|---|---|
| 55 | Yes | 55 |
| 93 | Yes | 93 |
| 221 | Yes | 221 |
| 245 | Yes | 245 |

The variant protein has the following domains, as determined by using InterPro. The domains are described in Table 14:

TABLE 14

InterPro domain(s)

| Domain description | Analysis type | Position(s) on protein |
|---|---|---|
| Fibronectin, type III | HMMPfam | 216-304 |
| Immunoglobulin-like | HMMPfam | 40-98 |
| Fibronectin, type III | HMMSmart | 216-301 |
| Immunoglobulin C2 type | HMMSmart | 38-103 |
| Immunoglobulin subtype | HMMSmart | 32-111 |
| Cytokine receptor, common beta | ProfileScan | 115-216 |
| Immunoglobulin-like | ProfileScan | 26-96 |
| Long hematopoietin receptor, soluble alpha chain | ScanRegExp | 214-255 |

Variant protein HSI6REC_P2 (SEQ ID NO:25) is encoded by the following transcript(s): HSI6REC_T2 (SEQ ID NO:2), for which the sequence(s) is/are given at the end of the application. The coding portion of transcript HSI6REC_T2 (SEQ ID NO:2) is shown in bold; this coding portion starts at position 438 and ends at position 1889. The transcript also has the following SNPs as listed in Table 15 (given according to their position on the nucleotide sequence, with the alternative nucleic acid listed; the last column indicates whether the SNP is known or not; the presence of known SNPs in variant protein HSI6REC_P2 (SEQ ID NO:25) sequence provides support for the deduced sequence of this variant protein according to the present invention).

TABLE 15

Nucleic acid SNPs

| SNP position(s) on nucleotide sequence | Alternative nucleic acid(s) | Previously known SNP? |
|---|---|---|
| 230 | G -> A | Yes |
| 488 | A -> G | No |
| 530 | G -> A | Yes |
| 647 | C -> T | Yes |
| 679 | T -> G | Yes |
| 843 | C -> T | Yes |
| 1558 | A -> C | Yes |
| 1877 | C -> T | Yes |
| 1932 | C -> T | Yes |
| 2120 | T -> C | Yes |
| 2916 | C -> T | Yes |
| 3901 | A -> T | Yes |
| 4427 | T -> C | Yes |
| 5207 | C -> | No |
| 5520 | G -> A | Yes |
| 5893 | T -> | Yes |
| 5901 | T -> | No |

Variant protein HSI6REC_P4 (SEQ ID NO:26) according to the present invention has an amino acid sequence as given at the end of the application; it is encoded by transcript(s) HSI6REC_T4 (SEQ ID NO:3). An alignment is given to the known protein (Interleukin-6 receptor alpha chain precursor (SEQ ID NO:20)) at the end of the application. One or more alignments to one or more previously published protein sequences are given at the end of the application. A brief description of the relationship of the variant protein according to the present invention to each such aligned protein is as follows:

1. Comparison Report Between HSI6REC_P4 (SEQ ID NO:26) and IL6RA_HUMAN (SEQ ID NO:590):

A. An isolated chimeric polypeptide encoding for HSI6REC_P4 (SEQ ID NO:26), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFTTWM corresponding to amino acids 1-269 of IL6RA_HUMAN (SEQ ID NO:590), which also corresponds to amino acids 1-269 of HSI6REC_P4 (SEQ ID NO:26), and a second amino acid sequence being at least 70%, optionally at least 80%, preferably at least 85%, more preferably at least 90% and most preferably at least 95% homologous to a polypeptide having the sequence NPGVLQLRTRCPPPCRHLLLIKT-MIIFSSEILQMRQASQCKILLQYHCPH-SWLLEGAWPSER SSALPLF (SEQ ID NO:522) corresponding to amino acids 270-338 of HSI6REC_P4 (SEQ ID NO:26), wherein said first amino acid sequence and second amino acid sequence are contiguous and in a sequential order.

B. An isolated polypeptide encoding for an edge portion of HSI6REC_P4 (SEQ ID NO:26), comprising an amino acid sequence being at least 70%, optionally at least about 80%, preferably at least about 85%, more preferably at least about 90% and most preferably at least about 95% homologous to the sequence NPGVLQLRTRCPPPCRHLLLIKTMIIF-SSEILQMRQASQCKILLQYHCPHSWLLEGAWPSER SSALPLF (SEQ ID NO:522) of HSI6REC_P4 (SEQ ID NO:26).

2. Comparison Report Between HSI6REC_P4 (SEQ ID NO:26) and P08887-2 (SEQ ID NO:22):

A. An isolated chimeric polypeptide encoding for HSI6REC_P4 (SEQ ID NO:26), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFTTWM corresponding to amino acids 1-269 of P08887-2 (SEQ ID NO:22), which also corresponds to amino acids 1-269 of HSI6REC_P4 (SEQ ID NO:26), and a second amino acid sequence being at least 70%, optionally at least 80%, preferably at least 85%, more preferably at least 90% and most preferably at least 95% homologous to a polypeptide having the sequence NPGVLQLRTRCPPPCRHLLLIKTMIIFS SEILQMRQASQCKILLQYHCPHSWLLEGAWPSER SSALPLF (SEQ ID NO:522) corresponding to amino acids 270-338 of HSI6REC_P4 (SEQ ID NO:26), wherein said first amino acid sequence and second amino acid sequence are contiguous and in a sequential order.

B. An isolated polypeptide encoding for an edge portion of HSI6REC_P4 (SEQ ID NO:26), comprising an amino acid sequence being at least 70%, optionally at least about 80%, preferably at least about 85%, more preferably at least about 90% and most preferably at least about 95% homologous to the sequence NPGVLQLRTRCPPPCRHLLLIKTMIIFSSEILQMRQASQCKILLQYHCPHSWLLEGAWPSERSSALPLF (SEQ ID NO:522) of HSI6REC_P4 (SEQ ID NO:26).

3. Comparison Report Between HSI6REC_P4 (SEQ ID NO:26) and NP_852004 (SEQ ID NO:23):

A. An isolated chimeric polypeptide encoding for HSI6REC_P4 (SEQ ID NO:26), comprising a first amino acid sequence being at least 90% homologous to MLAVGCALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLSVTW QDPHSWNSSFYRLRFELRYRAERSKTFTTWM corresponding to amino acids 1-269 of NP_852004 (SEQ ID NO:23), which also corresponds to amino acids 1-269 of HSI6REC_P4 (SEQ ID NO:26), and a second amino acid sequence being at least 70%, optionally at least 80%, preferably at least 85%, more preferably at least 90% and most preferably at least 95% homologous to a polypeptide having the sequence NPGVLQLRTRCPPPCRHLLLIKTMIIF-SSEILQMRQASQCKILLQYHCPHSWLLEGAWPSER SSALPLF (SEQ ID NO:522) corresponding to amino acids 270-338 of HSI6REC_P4 (SEQ ID NO:26), wherein said first amino acid sequence and second amino acid sequence are contiguous and in a sequential order.

B. An isolated polypeptide encoding for an edge portion of HSI6REC_P4 (SEQ ID NO:26), comprising an amino acid sequence being at least 70%, optionally at least about 80%, preferably at least about 85%, more preferably at least about 90% and most preferably at least about 95% homologous to the sequence NPGVLQLRTRCPPPCRHLLLIKTMIIF-SSEILQMRQASQCKILLQYHCPHSWLLEGAWPSER SSALPLF (SEQ ID NO:522) of HSI6REC_P4 (SEQ ID NO:26).

4. Comparison Report Between HSI6REC_P4 (SEQ ID NO:26) and NP_000556 (SEQ ID NO:21):

A. An isolated chimeric polypeptide encoding for HSI6REC_P4 (SEQ ID NO:26), comprising a first amino acid sequence being at least 90% homologous to MLAVGCALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFTTWM corresponding to amino acids 1-269 of NP_000556 (SEQ ID NO:21), which also corresponds to amino acids 1-269 of HSI6REC_P4 (SEQ ID NO:26), and a second amino acid sequence being at least 70%, optionally at least 80%, preferably at least 85%, more preferably at least 90% and most preferably at least 95% homologous to a polypeptide having the sequence NPGVLQLRTRCPPPCRHLLLIKTMIIF-SSEILQMRQASQCKILLQYHCPHSWLLEGAWPSER SSALPLF (SEQ ID NO:522) corresponding to amino acids 270-338 of HSI6REC_P4 (SEQ ID NO:26), wherein said first amino acid sequence and second amino acid sequence are contiguous and in a sequential order.

B. An isolated polypeptide encoding for an edge portion of HSI6REC_P4 (SEQ ID NO:26), comprising an amino acid sequence being at least 70%, optionally at least about 80%, preferably at least about 85%, more preferably at least about 90% and most preferably at least about 95% homologous to the sequence NPGVLQLRTRCPPPCRHLLLIKTMIIF-SSEILQMRQASQCKILLQYHCPHSWLLEGAWPSER SSALPLF (SEQ ID NO:522) of HSI6REC_P4 (SEQ ID NO:26).

The localization of the variant protein was determined according to results from a number of different software programs and analyses, including analyses from SignalP and other specialized programs. The variant protein is believed to be located as follows with regard to the cell: secreted.

Variant protein HSI6REC_P4 (SEQ ID NO:26) also has the following non-silent SNPs (Single Nucleotide Polymorphisms) as listed in Table 16, (given according to their position(s) on the amino acid sequence, with the alternative amino acid(s) listed; the last column indicates whether the SNP is known or not; the presence of known SNPs in variant protein HSI6REC_P4 (SEQ ID NO:26) sequence provides support for the deduced sequence of this variant protein according to the present invention).

TABLE 16

Amino acid mutations

| SNP position(s) on amino acid sequence | Alternative amino acid(s) | Previously known SNP? |
| --- | --- | --- |
| 81 | L -> R | Yes |
| 136 | P -> S | Yes |
| 311 | I -> L | Yes |

The glycosylation sites of variant protein HSI6REC_P4 (SEQ ID NO:26), as compared to the known protein Interleukin-6 receptor alpha chain precursor (SEQ ID NO:20), are described in Table 17 (given according to their position(s) on the amino acid sequence in the first column; the second column indicates whether the glycosylation site is present in the variant protein; and the last column indicates whether the position is different on the variant protein).

TABLE 17

Glycosylation site(s)

| Position(s) on known amino acid sequence | Present in variant protein? | Position(s) on variant protein |
| --- | --- | --- |
| 55 | Yes | 55 |
| 93 | Yes | 93 |
| 221 | Yes | 221 |
| 245 | Yes | 245 |

The variant protein has the following domains, as determined by using InterPro. The domains are described in Table 18:

TABLE 18

InterPro domain(s)

| Domain description | Analysis type | Position(s) on protein |
|---|---|---|
| Immunoglobulin-like | HMMPfam | 40-98 |
| Immunoglobulin C2 type | HMMSmart | 38-103 |
| Immunoglobulin subtype | HMMSmart | 32-111 |
| Cytokine receptor, common beta | ProfileScan | 115-216 |
| Immunoglobulin-like | ProfileScan | 26-96 |
| Long hematopoietin receptor, soluble alpha chain | ScanRegExp | 214-255 |

Variant protein HSI6REC_P4 (SEQ ID NO:26) is encoded by the following transcript(s): HSI6REC_T4 (SEQ ID NO:3), for which the sequence(s) is/are given at the end of the application. The coding portion of transcript HSI6REC_T4 (SEQ ID NO:3) is shown in bold; this coding portion starts at position 438 and ends at position 1451. The transcript also has the following SNPs as listed in Table 19 (given according to their position on the nucleotide sequence, with the alternative nucleic acid listed; the last column indicates whether the SNP is known or not; the presence of known SNPs in variant protein HSI6REC_P4 (SEQ ID NO:26) sequence provides support for the deduced sequence of this variant protein according to the present invention).

TABLE 19

Nucleic acid SNPs

| SNP position(s) on nucleotide sequence | Alternative nucleic acid(s) | Previously known SNP? |
|---|---|---|
| 230 | G -> A | Yes |
| 488 | A -> G | No |
| 530 | G -> A | Yes |
| 647 | C -> T | Yes |
| 679 | T -> G | Yes |
| 843 | C -> T | Yes |
| 1368 | A -> C | Yes |
| 1687 | C -> T | Yes |
| 1742 | C -> T | Yes |
| 1930 | T -> C | Yes |
| 2726 | C -> T | Yes |
| 3711 | A -> T | Yes |
| 4237 | T -> C | Yes |
| 5017 | C -> | No |
| 5330 | G -> A | Yes |
| 5703 | T -> | Yes |
| 5711 | T -> | No |

Variant protein HSI6REC_P5 (SEQ ID NO:27) according to the present invention has an amino acid sequence as given at the end of the application; it is encoded by transcript(s) HSI6REC_T5 (SEQ ID NO:4). An alignment is given to the known protein (Interleukin-6 receptor alpha chain precursor (SEQ ID NO:20)) at the end of the application. One or more alignments to one or more previously published protein sequences are given at the end of the application. A brief description of the relationship of the variant protein according to the present invention to each such aligned protein is as follows:

1. Comparison Report Between HSI6REC_P5 (SEQ ID NO:27) and IL6RA_HUMAN (SEQ ID 0):

A. An isolated chimeric polypeptide encoding for HSI6REC_P5 (SEQ ID NO:27), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWTESRSPPAENEVSTPMQ corresponding to amino acids 1-332 of IL6RA_HUMAN (SEQ ID NO:590), which also corresponds to amino acids 1-332 of HSI6REC_P5 (SEQ ID NO:27), and a second amino acid sequence being at least 70%, optionally at least 80%, preferably at least 85%, more preferably at least 90% and most preferably at least 95% homologous to a polypeptide having the sequence VQEDVEAAGSEGRQDKHASAVLF-GAAGPGEASTHPSACSSHLPTGVPQQPGV (SEQ ID NO:523) corresponding to amino acids 333-384 of HSI6REC_P5 (SEQ ID NO:27), wherein said first amino acid sequence and second amino acid sequence are contiguous and in a sequential order.

B. An isolated polypeptide encoding for an edge portion of HSI6REC_P5 (SEQ ID NO:27), comprising an amino acid sequence being at least 70%, optionally at least about 80%, preferably at least about 85%, more preferably at least about 90% and most preferably at least about 95% homologous to the sequence VQEDVEAAGSEGRQDKHASAVLFGAAG-PGEASTHPSACSSHLPTGVPQQPGV (SEQ ID NO:523) of HSI6REC_P5 (SEQ ID NO:27).

2. Comparison Report Between HSI6REC_P5 (SEQ ID NO:27) and P08887-2 (SEQ ID NO:22):

A. An isolated chimeric polypeptide encoding for HSI6REC_P5 (SEQ ID NO:27), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWTESRSPPAENEVSTPMQ corresponding to amino acids 1-332 of P08887-2 (SEQ ID NO:22), which also corresponds to amino acids 1-332 of HSI6REC_P5 (SEQ ID NO:27), and a second amino acid sequence being at least 70%, optionally at least 80%, preferably at least 85%, more preferably at least 90% and most preferably at least 95% homologous to a polypeptide having the sequence VQEDVEAAGSEGRQDKHASAVLFGAAG-PGEASTHPSACSSHLPTGVPQQPGV (SEQ ID NO:523) corresponding to amino acids 333-384 of HSI6REC_P5 (SEQ ID NO:27), wherein said first amino acid sequence and second amino acid sequence are contiguous and in a sequential order.

B. An isolated polypeptide encoding for an edge portion of HSI6REC_P5 (SEQ ID NO:27), comprising an amino acid sequence being at least 70%, optionally at least about 80%, preferably at least about 85%, more preferably at least about 90% and most preferably at least about 95% homologous to the sequence VQEDVEAAGSEGRQDKHASAVLFGAAG-PGEASTHPSACSSHLPTGVPQQPGV (SEQ ID NO:523) of HSI6REC_P5 (SEQ ID NO:27).

3. Comparison Report Between HSI6REC_P5 (SEQ ID NO:27) and NP_852004 (SEQ ID NO:23):

A. An isolated chimeric polypeptide encoding for HSI6REC_P5 (SEQ ID NO:27), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWTESRSPPAENEVSTPMQ corresponding to amino acids 1-332 of NP_852004 (SEQ ID NO:23), which also corresponds to amino acids 1-332 of HSI6REC_P5 (SEQ ID NO:27), and a second amino acid sequence being at least 70%, optionally at least 80%, preferably at least 85%, more preferably at least 90% and most preferably at least 95% homologous to a polypeptide having the sequence VQEDVEAAGSEGRQDKHASAVLFGAAG-PGEASTHPSACSSHLPTGVPQQPGV (SEQ ID NO:523) corresponding to amino acids 333-384 of HSI6REC_P5 (SEQ ID NO:27), wherein said first amino acid sequence and second amino acid sequence are contiguous and in a sequential order.

B. An isolated polypeptide encoding for an edge portion of HSI6REC_P5 (SEQ ID NO:27), comprising an amino acid sequence being at least 70%, optionally at least about 80%, preferably at least about 85%, more preferably at least about 90% and most preferably at least about 95% homologous to the sequence VQEDVEAAGSEGRQDKHASAVLFGAAG-PGEASTHPSACSSHLPTGVPQQPGV (SEQ ID NO:523) of HSI6REC_P5 (SEQ ID NO:27).

4. Comparison Report Between HSI6REC_P5 (SEQ ID NO:27) and NP_000556 (SEQ ID NO:21):

A. An isolated chimeric polypeptide encoding for HSI6REC_P5 (SEQ ID NO:27), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWTESRSPPAENEVSTPMQ corresponding to amino acids 1-332 of NP_000556 (SEQ ID NO:21), which also corresponds to amino acids 1-332 of HSI6REC_P5 (SEQ ID NO:27), and a second amino acid sequence being at least 70%, optionally at least 80%, preferably at least 85%, more preferably at least 90% and most preferably at least 95% homologous to a polypeptide having the sequence VQEDVEAAGSEGRQDKHASAVLFGAAG-PGEASTHPSACSSHLPTGVPQQPGV (SEQ ID NO:523) corresponding to amino acids 333-384 of HSI6REC_P5 (SEQ ID NO:27), wherein said first amino acid sequence and second amino acid sequence are contiguous and in a sequential order.

B. An isolated polypeptide encoding for an edge portion of HSI6REC_P5 (SEQ ID NO:27), comprising an amino acid sequence being at least 70%, optionally at least about 80%, preferably at least about 85%, more preferably at least about 90% and most preferably at least about 95% homologous to the sequence VQEDVEAAGSEGRQDKHASAVLFGAAG-PGEASTHPSACSSHLPTGVPQQPGV (SEQ ID NO:523) of HSI6REC_P5 (SEQ ID NO:27).

The localization of the variant protein was determined according to results from a number of different software programs and analyses, including analyses from SignalP and other specialized programs. The variant protein is believed to be located as follows with regard to the cell: secreted.

Variant protein HSI6REC_P5 (SEQ ID NO:27) also has the following non-silent SNPs (Single Nucleotide Polymorphisms) as listed in Table 20, (given according to their position(s) on the amino acid sequence, with the alternative amino acid(s) listed; the last column indicates whether the SNP is known or not; the presence of known SNPs in variant protein HSI6REC_P5 (SEQ ID NO:27) sequence provides support for the deduced sequence of this variant protein according to the present invention).

TABLE 20

| Amino acid mutations | | |
|---|---|---|
| SNP position(s) on amino acid sequence | Alternative amino acid(s) | Previously known SNP? |
| 81 | L -> R | Yes |
| 136 | P -> S | Yes |

The glycosylation sites of variant protein HSI6REC_P5 (SEQ ID NO:27), as compared to the known protein Interleukin-6 receptor alpha chain precursor (SEQ ID NO:20), are described in Table 21 (given according to their position(s) on the amino acid sequence in the first column; the second column indicates whether the glycosylation site is present in the variant protein; and the last column indicates whether the position is different on the variant protein).

TABLE 21

| Glycosylation site(s) | | |
|---|---|---|
| Position(s) on known amino acid sequence | Present in variant protein? | Position(s) on variant protein |
| 55 | Yes | 55 |
| 93 | Yes | 93 |
| 221 | Yes | 221 |
| 245 | Yes | 245 |

The variant protein has the following domains, as determined by using InterPro. The domains are described in Table 22:

TABLE 22

| InterPro domain(s) | | |
|---|---|---|
| Domain description | Analysis type | Position(s) on protein |
| Fibronectin, type III | HMMPfam | 216-304 |
| Immunoglobulin-like | HMMPfam | 40-98 |
| Fibronectin, type III | HMMSmart | 216-301 |
| Immunoglobulin C2 type | HMMSmart | 38-103 |
| Immunoglobulin subtype | HMMSmart | 32-111 |
| Cytokine receptor, common beta | ProfileScan | 115-216 |
| Immunoglobulin-like | ProfileScan | 26-96 |
| Long hematopoietin receptor, soluble alpha chain | ScanRegExp | 214-255 |

Variant protein HSI6REC_P5 (SEQ ID NO:27) is encoded by the following transcript(s): HSI6REC_T5 (SEQ ID NO:4), for which the sequence(s) is/are given at the end of the application. The coding portion of transcript HSI6REC_T5 (SEQ ID NO:4) is shown in bold; this coding portion starts at position 438 and ends at position 1589. The transcript also has the following SNPs as listed in Table 23 (given according to their position on the nucleotide sequence, with the alternative nucleic acid listed; the last column indicates whether the SNP is known or not; the presence of known SNPs in variant protein HSI6REC_P5 (SEQ ID NO:27) sequence provides support for the deduced sequence of this variant protein according to the present invention).

TABLE 23

| | Nucleic acid SNPs | |
|---|---|---|
| SNP position(s) on nucleotide sequence | Alternative nucleic acid(s) | Previously known SNP? |
| 230 | G -> A | Yes |
| 488 | A -> G | No |
| 530 | G -> A | Yes |
| 647 | C -> T | Yes |
| 679 | T -> G | Yes |
| 843 | C -> T | Yes |
| 1665 | C -> T | Yes |
| 1720 | C -> T | Yes |
| 1908 | T -> C | Yes |
| 2704 | C -> T | Yes |
| 3689 | A -> T | Yes |
| 4215 | T -> C | Yes |
| 4995 | C -> | No |
| 5308 | G -> A | Yes |
| 5681 | T -> | Yes |
| 5689 | T -> | No |

Variant protein HSI6REC_P6 (SEQ ID NO:28) according to the present invention has an amino acid sequence as given at the end of the application; it is encoded by transcript(s) HSI6REC_T6 (SEQ ID NO:5) and HSI6REC_T7 (SEQ ID NO:6). An alignment is given to the known protein (Interleukin-6 receptor alpha chain precursor (SEQ ID NO:20)) at the end of the application. One or more alignments to one or more previously published protein sequences are given at the end of the application. A brief description of the relationship of the variant protein according to the present invention to each such aligned protein is as follows:

1. Comparison Report Between HSI6REC_P6 (SEQ ID NO:28) and IL6RA_HUMAN (SEQ ID NO:690):

A. An isolated chimeric polypeptide encoding for HSI6REC_P6 (SEQ ID NO:28), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWT corresponding to amino acids 1-316 of IL6RA_HUMAN (SEQ ID NO:590), which also corresponds to amino acids 1-316 of HSI6REC_P6 (SEQ ID NO:28), and a second amino acid sequence being at least 70%, optionally at least 80%, preferably at least 85%, more preferably at least 90% and most preferably at least 95% homologous to a polypeptide having the sequence DRL-SPRCPGWSTAVQSQLTATSASWVQAILPPQPPK (SEQ ID NO:524) corresponding to amino acids 317-352 of HSI6REC_P6 (SEQ ID NO:28), wherein said first amino acid sequence and second amino acid sequence are contiguous and in a sequential order.

B. An isolated polypeptide encoding for an edge portion of HSI6REC_P6 (SEQ ID NO:28), comprising an amino acid sequence being at least 70%, optionally at least about 80%, preferably at least about 85%, more preferably at least about 90% and most preferably at least about 95% homologous to the sequence DRLSPRCPGWSTAVQSQLTAT-SASWVQAILPPQPPK (SEQ ID NO:524) of HSI6REC_P6 (SEQ ID NO:28).

2. Comparison Report Between HSI6REC_P6 (SEQ ID NO:28) and P08887-2 (SEQ ID NO:22):

A. An isolated chimeric polypeptide encoding for HSI6REC_P6 (SEQ ID NO:28), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWT corresponding to amino acids 1-316 of P08887-2 (SEQ ID NO:22), which also corresponds to amino acids 1-316 of HSI6REC_P6 (SEQ ID NO:28), and a second amino acid sequence being at least 70%, optionally at least 80%, preferably at least 85%, more preferably at least 90% and most preferably at least 95% homologous to a polypeptide having the sequence DRL-SPRCPGWSTAVQSQLTATSASWVQAILPPQPPK (SEQ ID NO:524) corresponding to amino acids 317-352 of HSI6REC_P6 (SEQ ID NO:28), wherein said first amino acid sequence and second amino acid sequence are contiguous and in a sequential order.

B. An isolated polypeptide encoding for an edge portion of HSI6REC_P6 (SEQ ID NO:28), comprising an amino acid sequence being at least 70%, optionally at least about 80%, preferably at least about 85%, more preferably at least about 90% and most preferably at least about 95% homologous to the sequence DRLSPRCPGWSTAVQSQLTAT-SASWVQAILPPQPPK (SEQ ID NO:524) of HSI6REC_P6 (SEQ ID NO:28).

3. Comparison Report Between HSI6REC_P6 (SEQ ID NO:28) and NP_852004 (SEQ ID NO:23):

A. An isolated chimeric polypeptide encoding for HSI6REC_P6 (SEQ ID NO:28), comprising a first amino acid sequence being at least 90% homologous to MLAVG-CALLAALLAAPGAALAPRRCPAQE-VARGVLTSLPGDSVTLTCPGVEPEDNATVH WVLRK-PAAGSHPSRWAGMGRRLLLRSVQLHDSGNYSCYRAG RPAGTVHLLVDVPPEEP QLSCFRKSPLSNVVCEWG-PRSTPSLTTKAVLLVRKFQNSPAED-FQEPCQYSQESQKFSCQL AVPEGDSSFYIVSMCVASS-VGSKFSKTQTFQGCGILQPDPPANITVTAVARNPRWLS VTW QDPHSWNSSFYRLRFELRYRAERSKTFT-TWMVKDLQHHCVIHDAWSGLRHVVQLRAQE EFGQGEWSEWSPEAMGTPWT corresponding to amino acids 1-316 of NP_852004 (SEQ ID NO:23), which also corresponds to amino acids 1-316 of HSI6REC_P6 (SEQ ID NO:28), and a second amino acid sequence being at least 70%, optionally at least 80%, preferably at least 85%, more preferably at least 90% and most preferably at least 95% homologous to a polypeptide having the sequence DRL- SPRCPGWSTAVQSQLTATSASWVQAILPPQPPK (SEQ ID NO:524) corresponding to amino acids 317-352 of HSI6REC_P6 (SEQ ID NO:28), wherein said first amino acid sequence and second amino acid sequence are contiguous and in a sequential order.

B. An isolated polypeptide encoding for an edge portion of HSI6REC_P6 (SEQ ID NO:28), comprising an amino acid sequence being at least 70%, optionally at least about 80%, preferably at least about 85%, more preferably at least about 90% and most preferably at least about 95% homologous to the sequence DRLSPRCPGWSTAVQSQLTATSASWVQAILPPQPPK (SEQ ID NO:524) of HSI6REC_P6 (SEQ ID NO:28).

4. Comparison Report Between HSI6REC_P6 (SEQ ID NO:28) and NP_000556 (SEQ ID NO:21):

A. An isolated chimeric polypeptide encoding for HSI6REC_P6 (SEQ ID NO:28), comprising a first amino acid sequence being at least 90% homologous to MLAVGCALLAALLAAPGAALAPRRCPAQEVARGVLTSLPGDSVTLTCPGVEPEDNATVH WVLRKPAAGSHPSRWAGMGRRLLLRSVQLHDSGNYSCYRAGRPAGTVHLLVDVPPEEP QLSCFRKSPLSNVVCEWGPRSTPSLTTKAVLLVRKFQNSPAEDFQEPCQYSQESQKFSCQL AVPEGDSSFYIVSMCVASSVGSKFSKTQTFQGCGILQPDPPANITVTAVARNPRWLS VTW QDPHSWNSSFYRLRFELRYRAERSKTFTTWMVKDLQHHCVIHDAWSGLRHVVQLRAQE EFGQGEWSEWSPEAMGTPWT corresponding to amino acids 1-316 of NP_000556 (SEQ ID NO:21), which also corresponds to amino acids 1-316 of HSI6REC_P6 (SEQ ID NO:28), and a second amino acid sequence being at least 70%, optionally at least 80%, preferably at least 85%, more preferably at least 90% and most preferably at least 95% homologous to a polypeptide having the sequence DRLSPRCPGWSTAVQSQLTATSASWVQAILPPQPPK (SEQ ID NO:524) corresponding to amino acids 317-352 of HSI6REC_P6 (SEQ ID NO:28), wherein said first amino acid sequence and second amino acid sequence are contiguous and in a sequential order.

B. An isolated polypeptide encoding for an edge portion of HSI6REC_P6 (SEQ ID NO:28), comprising an amino acid sequence being at least 70%, optionally at least about 80%, preferably at least about 85%, more preferably at least about 90% and most preferably at least about 95% homologous to the sequence DRLSPRCPGWSTAVQSQLTATSASWVQAILPPQPPK (SEQ ID NO:524) of HSI6REC_P6 (SEQ ID NO:28).

The localization of the variant protein was determined according to results from a number of different software programs and analyses, including analyses from SignalP and other specialized programs. The variant protein is believed to be located as follows with regard to the cell: secreted.

Variant protein HSI6REC_P6 (SEQ ID NO:28) also has the following non-silent SNPs (Single Nucleotide Polymorphisms) as listed in Table 24, (given according to their position(s) on the amino acid sequence, with the alternative amino acid(s) listed; the last column indicates whether the SNP is known or not; the presence of known SNPs in variant protein HSI6REC_P6 (SEQ ID NO:28) sequence provides support for the deduced sequence of this variant protein according to the present invention).

TABLE 24

| Amino acid mutations | | |
|---|---|---|
| SNP position(s) on amino acid sequence | Alternative amino acid(s) | Previously known SNP? |
| 81 | L -> R | Yes |
| 136 | P -> S | Yes |

The glycosylation sites of variant protein HSI6REC_P6 (SEQ ID NO:28), as compared to the known protein Interleukin-6 receptor alpha chain precursor (SEQ ID NO:20), are described in Table 25 (given according to their position(s) on the amino acid sequence in the first column; the second column indicates whether the glycosylation site is present in the variant protein; and the last column indicates whether the position is different on the variant protein).

TABLE 25

| Glycosylation site(s) | | |
|---|---|---|
| Position(s) on known amino acid sequence | Present in variant protein? | Position(s) on variant protein |
| 55 | Yes | 55 |
| 93 | Yes | 93 |
| 221 | Yes | 221 |
| 245 | Yes | 245 |

The variant protein has the following domains, as determined by using InterPro. The domains are described in Table 26:

TABLE 26

| InterPro domain(s) | | |
|---|---|---|
| Domain description | Analysis type | Position(s) on protein |
| Fibronectin, type III | HMMPfam | 216-304 |
| Immunoglobulin-like | HMMPfam | 40-98 |
| Fibronectin, type III | HMMSmart | 216-301 |
| Immunoglobulin C2 type | HMMSmart | 38-103 |
| Immunoglobulin subtype | HMMSmart | 32-111 |
| Cytokine receptor, common beta | ProfileScan | 115-216 |
| Immunoglobulin-like | ProfileScan | 26-96 |
| Long hematopoietin receptor, soluble alpha chain | ScanRegExp | 214-255 |

Variant protein HSI6REC_P6 (SEQ ID NO:28) is encoded by the following transcript(s): HSI6REC_T6 (SEQ ID NO:5) and HSI6REC_T7 (SEQ ID NO:6), for which the sequence(s) is/are given at the end of the application.

The coding portion of transcript HSI6REC_T6 (SEQ ID NO:5) is shown in bold; this coding portion starts at position 438 and ends at position 1493. The transcript also has the following SNPs as listed in Table 27 (given according to their position on the nucleotide sequence, with the alternative nucleic acid listed; the last column indicates whether the SNP is known or not; the presence of known SNPs in variant protein HSI6REC_P6 (SEQ ID NO:28) sequence provides support for the deduced sequence of this variant protein according to the present invention).

TABLE 27

Nucleic acid SNPs

| SNP position(s) on nucleotide sequence | Alternative nucleic acid(s) | Previously known SNP? |
|---|---|---|
| 230 | G -> A | Yes |
| 488 | A -> G | No |
| 530 | G -> A | Yes |
| 647 | C -> T | Yes |
| 679 | T -> G | Yes |
| 843 | C -> T | Yes |
| 1958 | G -> A | No |
| 1966 | T -> C | No |

The coding portion of transcript HSI6REC_T7 (SEQ ID NO:6) is shown in bold; this coding portion starts at position 438 and ends at position 1493. The transcript also has the following SNPs a listed in Table 28 (given according to their position on the nucleotide sequence, with the alternative nucleic acid listed; the last column indicates whether the SNP is known or not; the presence of known SNPs in variant protein HSI6REC_P6 (SEQ ID NO:28) sequence provides support of the deduced sequence of this variant protein according to the present invention).

TABLE 28

Nucleic acid SNPs

| SNP position(s) on nucleotide sequence | Alternative nucleic acid(s) | Previously known SNP? |
|---|---|---|
| 230 | G -> A | Yes |
| 488 | A -> G | No |
| 530 | G -> A | Yes |
| 647 | C -> T | Yes |
| 679 | T -> G | Yes |
| 843 | C -> T | Yes |
| 1958 | G -> A | No |
| 1966 | T -> C | No |
| 2160 | C -> G | No |
| 2431 | C -> T | Yes |

As noted above, cluster HSI6REC features 13 segment(s), which were listed in Table 6 above and for which the sequence(s) are given at the end of the application. These segment(s) are portions of nucleic acid sequence(s) which are described herein separately because they are of particular interest. A description of each segment according to the present invention is now provided.

Segment cluster HSI6REC_N0 (SEQ ID NO:7) according to the present invention is supported by 18 libraries. The number of libraries was determined as previously described. This segment can be found in the following transcript(s): HSI6REC_T1 (SEQ ID NO:1), HSI6REC_T2 (SEQ ID NO:2), HSI6REC_T4 (SEQ ID NO:3), HSI6REC_T5 (SEQ ID NO:4), HSI6REC_T6 (SEQ ID NO:5) and HSI6REC_T7 (SEQ ID NO:6). Table 29 below describes the starting and ending position of this segment on each transcript.

TABLE 29

Segment location on transcripts

| Transcript name | Segment starting position | Segment ending position |
|---|---|---|
| HSI6REC_T1 (SEQ ID NO: 1) | 1 | 522 |
| HSI6REC_T2 (SEQ ID NO: 2) | 1 | 522 |
| HSI6REC_T4 (SEQ ID NO: 3) | 1 | 522 |

TABLE 29-continued

Segment location on transcripts

| Transcript name | Segment starting position | Segment ending position |
|---|---|---|
| HSI6REC_T5 (SEQ ID NO: 4) | 1 | 522 |
| HSI6REC_T6 (SEQ ID NO: 5) | 1 | 522 |
| HSI6REC_T7 (SEQ ID NO: 6) | 1 | 522 |

Segment cluster HSI6REC_N2 (SEQ ID NO:8) according to the present invention is supported by 24 libraries. The number of libraries was determined as previously described. This segment can be found in the following transcript(s): HSI6REC_T1 (SEQ ID NO: 1), HSI6REC_T2 (SEQ ID NO:2), HSI6REC_T4 (SEQ ID NO:3), HSI6REC_T5 (SEQ ID NO:4), HSI6REC_T6 (SEQ ID NO:5) and HSI6REC_T7 (SEQ ID NO:6). Table 30 below describes the starting and ending position of this segment on each transcript.

TABLE 30

Segment location on transcripts

| Transcript name | Segment starting position | Segment ending position |
|---|---|---|
| HSI6REC_T1 (SEQ ID NO: 1) | 523 | 771 |
| HSI6REC_T2 (SEQ ID NO: 2) | 523 | 771 |
| HSI6REC_T4 (SEQ ID NO: 3) | 523 | 771 |
| HSI6REC_T5 (SEQ ID NO: 4) | 523 | 771 |
| HSI6REC_T6 (SEQ ID NO: 5) | 523 | 771 |
| HSI6REC_T7 (SEQ ID NO: 6) | 523 | 771 |

Segment cluster HSI6REC_N4 (SEQ ID NO:9) according to the present invention is supported by 24 libraries. The number of libraries was determined as previously described. This segment can be found in the following transcript(s): HSI6REC_T1 (SEQ ID NO:1), HSI6REC_T2 (SEQ ID NO:2), HSI6REC_T4 (SEQ ID NO:3), HSI6REC_T5 (SEQ ID NO:4), HSI6REC$_6$ (SEQ ID NO:5) and HSI6REC_T7 (SEQ ID NO:6). Table 31 below describes the starting and ending position of this segment on each transcript.

TABLE 31

Segment location on transcripts

| Transcript name | Segment starting position | Segment ending position |
|---|---|---|
| HSI6REC_T1 (SEQ ID NO: 1) | 772 | 895 |
| HSI6REC_T2 (SEQ ID NO: 2) | 772 | 895 |
| HSI6REC_T4 (SEQ ID NO: 3) | 772 | 895 |
| HSI6REC_T5 (SEQ ID NO: 4) | 772 | 895 |
| HSI6REC_T6 (SEQ ID NO: 5) | 772 | 895 |
| HSI6REC_T7 (SEQ ID NO: 6) | 772 | 895 |

Segment cluster HSI6REC_N6 (SEQ ID NO:10) according to the present invention is supported by 31 libraries. The number of libraries was determined as previously described. This segment can be found in the following transcript(s): HSI6REC_T1 (SEQ ID NO:1), HSI6REC_T2 (SEQ ID NO:2), HSI6REC_T4 (SEQ ID NO:3), HSI6REC_T5 (SEQ ID NO:4), HSI6REC_T6 (SEQ ID NO:5) and HSI6REC_T7 (SEQ ID NO:6). Table 32 below describes the starting and ending position of this segment on each transcript.

TABLE 32

Segment location on transcripts

| Transcript name | Segment starting position | Segment ending position |
|---|---|---|
| HSI6REC__T1 (SEQ ID NO: 1) | 896 | 1077 |
| HSI6REC__T2 (SEQ ID NO: 2) | 896 | 1077 |
| HSI6REC__T4 (SEQ ID NO: 3) | 896 | 1077 |
| HSI6REC__T5 (SEQ ID NO: 4) | 896 | 1077 |
| HSI6REC__T6 (SEQ ID NO: 5) | 896 | 1077 |
| HSI6REC__T7 (SEQ ID NO: 6) | 896 | 1077 |

Segment cluster HSI6REC_N8 (SEQ ID NO:11) according to the present invention is supported by 31 libraries. The number of libraries was determined as previously described. This segment can be found in the following transcript(s): HSI6REC_T1 (SEQ ID NO: 1), HSI6REC_T2 (SEQ ID NO:2), HSI6REC_T4 (SEQ ID NO:3), HSI6REC_T5 (SEQ ID NO:4), HSI6REC_T6 (SEQ ID NO:5) and HSI6REC_T7 (SEQ ID NO:6). Table 33 below describes the starting and ending position of this segment on each transcript.

TABLE 33

Segment location on transcripts

| Transcript name | Segment starting position | Segment ending position |
|---|---|---|
| HSI6REC__T1 (SEQ ID NO: 1) | 1078 | 1244 |
| HSI6REC__T2 (SEQ ID NO: 2) | 1078 | 1244 |
| HSI6REC__T4 (SEQ ID NO: 3) | 1078 | 1244 |
| HSI6REC__T5 (SEQ ID NO: 4) | 1078 | 1244 |
| HSI6REC__T6 (SEQ ID NO: 5) | 1078 | 1244 |
| HSI6REC__T7 (SEQ ID NO: 6) | 1078 | 1244 |

Segment cluster HSI6REC_N10 (SEQ I) NO:12) according to the present invention is supported by 29 libraries. The number of libraries was determined as previously described. This segment can be found in the following transcript(s): HSI6REC_T1 (SEQ ID NO:1), HSI6REC_T2 (SEQ ID NO:2), HSI6REC_T5 (SEQ ID NO:4), HSI6REC_T6 (SEQ ID NO:5) and HSI6REC_T7 (SEQ ID NO:6). Table 34 below describes the starting and ending position of this segment on each transcript.

TABLE 34

Segment location on transcripts

| Transcript name | Segment starting position | Segment ending position |
|---|---|---|
| HSI6REC__T1 (SEQ ID NO: 1) | 1245 | 1386 |
| HSI6REC__T2 (SEQ ID NO: 2) | 1245 | 1386 |
| HSI6REC__T5 (SEQ ID NO: 4) | 1245 | 1386 |
| HSI6REC__T6 (SEQ ID NO: 5) | 1245 | 1386 |
| HSI6REC__T7 (SEQ ID NO: 6) | 1245 | 1386 |

Segment cluster HSI6REC_N12 (SEQ ID NO: 13) according to the present invention is supported by 5 libraries. The number of libraries was determined as previously described. This segment can be found in the following transcript(s): HSI6REC_T6 (SEQ ID NO:5) and HSI6REC_T7 (SEQ ID NO:6). Table 35 below describes the starting and ending position of this segment on each transcript.

TABLE 35

Segment location on transcripts

| Transcript name | Segment starting position | Segment ending position |
|---|---|---|
| HSI6REC__T6 (SEQ ID NO: 5) | 1387 | 2036 |
| HSI6REC__T7 (SEQ ID NO: 6) | 1387 | 2471 |

Segment cluster HSI6REC_N25 (SEQ ID NO:14) according to the present invention is supported by 226 libraries. The number of libraries was determined as previously described. This segment can be found in the following transcript(s): HSI6REC_T1 (SEQ ID NO:1), HSI6REC_T2 (SEQ ID NO:2), HSI6REC_T4 (SEQ ID NO:3) and HSI6REC_T5 (SEQ ID NO:4). Table 36 below describes the starting and ending position of this segment on each transcript.

Table 36—Segment location on transcripts

TABLE 36

Segment location on transcripts

| Transcript name | Segment starting position | Segment ending position |
|---|---|---|
| HSI6REC__T1 (SEQ ID NO: 1) | 1691 | 6008 |
| HSI6REC__T2 (SEQ ID NO: 2) | 1646 | 5963 |
| HSI6REC__T4 (SEQ ID NO: 3) | 1456 | 5773 |
| HSI6REC__T5 (SEQ ID NO: 4) | 1434 | 5751 |

According to an optional embodiment of the present invention, short segments related to the above cluster are also provided. These segments are up to about 120 bp in length, and so are included in a separate description.

Segment cluster HSI6REC_N14 (SEQ ID NO:15) according to the present invention is supported by 2 libraries. The number of libraries was determined as previously described. This segment can be found in the following transcript(s): HSI6REC_T2 (SEQ ID NO:2). Table 37 below describes the starting and ending position of this segment on each transcript.

TABLE 37

Segment location on transcripts

| Transcript name | Segment starting position | Segment ending position |
|---|---|---|
| HSI6REC__T2 (SEQ ID NO: 2) | 1387 | 1434 |

Segment cluster HSI6REC_N16 (SEQ ID NO:16) according to the present invention is supported by 1 libraries. The number of libraries was determined as previously described. This segment can be found in the following transcript(s): HSI6REC_T1 (SEQ ID NO:1). Table 38 below describes the starting and ending position of this segment on each transcript.

TABLE 38

| Transcript name | Segment location on transcripts | |
|---|---|---|
| | Segment starting position | Segment ending position |
| HSI6REC_T1 (SEQ ID NO: 1) | 1387 | 1479 |

Segment cluster HSI6REC_N18 (SEQ ID NO: 17) according to the present invention is supported by 28 libraries. The number of libraries was determined as previously described. This segment can be found in the following transcript(s): HSI6REC_T1 (SEQ ID NO: 1), HSI6REC_T2 (SEQ ID NO:2), HSI6REC_T4 (SEQ ID NO:3) and HSI6REC_T5 (SEQ ID NO:4). Table 39 below describes the starting and ending position of this segment on each transcript.

TABLE 39

| Transcript name | Segment location on transcripts | |
|---|---|---|
| | Segment starting position | Segment ending position |
| HSI6REC_T1 (SEQ ID NO: 1) | 1480 | 1526 |
| HSI6REC_T2 (SEQ ID NO: 2) | 1435 | 1481 |
| HSI6REC_T4 (SEQ ID NO: 3) | 1245 | 1291 |
| HSI6REC_T5 (SEQ ID NO: 4) | 1387 | 1433 |

Segment cluster HSI6REC_N20 (SEQ ID NO: 18) according to the present invention is supported by 27 libraries. The number of libraries was determined as previously described. This segment can be found in the following transcript(s): HSI6REC_T1 (SEQ ID NO:1), HSI6REC_T2 (SEQ ID NO:2) and HSI6REC_T4 (SEQ ID NO:3). Table 40 below describes the starting and ending position of this segment on each transcript.

TABLE 40

| Transcript name | Segment location on transcripts | |
|---|---|---|
| | Segment starting position | Segment ending position |
| HSI6REC_T1 (SEQ ID NO: 1) | 1527 | 1596 |
| HSI6REC_T2 (SEQ ID NO: 2) | 1482 | 1551 |
| HSI6REC_T4 (SEQ ID NO: 3) | 1292 | 1361 |

Segment cluster HSI6REC_N23 (SEQ ID NO:19) according to the present invention is supported by 27 libraries. The number of libraries was determined as previously described. This segment can be found in the following transcript(s): HSI6REC_T1 (SEQ ID NO:1), HSI6REC_T2 (SEQ ID NO:2) and HSI6REC_T4 (SEQ ID NO:3). Table 41 below describes the starting and ending position of this segment on each transcript.

TABLE 41

| Transcript name | Segment location on transcripts | |
|---|---|---|
| | Segment starting position | Segment ending position |
| HSI6REC_T1 (SEQ ID NO: 1) | 1597 | 1690 |
| HSI6REC_T2 (SEQ ID NO: 2) | 1552 | 1645 |
| HSI6REC_T4 (SEQ ID NO: 3) | 1362 | 1455 |

The alignment of HSI6REC variant proteins to the previously known proteins is shown in the attached CD-Rom.

Expression of *Homo sapiens* Interleukin 6 Receptor (IL6R) HSI6REC Transcripts Which Are Detectable by Amplicon as Depicted in Sequence Name HSI6REC Junc10-16-18 (SEQ ID NO:468) in Normal and Cancerous Breast Tissues:

Expression of *Homo sapiens* interleukin 6 receptor (IL6R) transcripts detectable by or according to junc10-16-18, HSI6REC junc10-16-18 (SEQ ID NO:468) amplicon(s) and primers HSI6RECjunc10-16-18F (SEQ ID NO:466) and HSI6RECjunc10-16-18R (SEQ ID NO:467) was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1—amplicon (SEQ ID NO:437)), SDHA (GenBank Accession No. NM_004168 (SEQ ID NO:462); amplicon —SDHA-amplicon (SEQ ID NO:465)) and G6PD (GenBank Accession No. NM_000402 (SEQ ID NO:442); G6PD amplicon (SEQ ID NO:445)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 2_5, above, "Tissue samples in brest cancer testing panel"), to obtain a value of fold differential expression for each sample relative to median of the normal PM samples.

In one experiment that was carried out no differential expression in the cancerous samples relative to the normal PM samples was observed.

Primer pairs are also optionally and preferably encompassed within the present invention; for example, for the above experiment, the following primer pair was used as a non-limiting illustrative example only of a suitable primer pair: HSI6REC junc10-16-18F (SEQ ID NO:466) forward primer; and HSI6REC junc10-16-18R (SEQ ID NO:467) reverse primer.

The present invention also preferably encompasses any amplicon obtained through the use of any suitable primer pair; for example, for the above experiment, the following amplicon was obtained as a non-limiting illustrative example only of a suitable amplicon: HSI6REC junc10-16-18 (SEQ ID NO:468).

Primers:

```
Forward primer HSI6REC junc10-16-18F (SEQ ID NO: 466):
TCGTGCCCAGGAGGAGTTC

Reverse primer HSI6REC junc10-16-18R (SEQ ID NO: 467):
CTGGAGGACTCCTGGATTCTGTAA

Amplicon HSI6REC junc10-16-18 (SEQ ID NO: 468):
TCGTGCCCAGGAGGAGTTCGGGCAAGGCGAGTGGAGCGAGTGGAGCCCGGAGGCCA

TGGGCACGCCTTGGACAGAGATGAGGTCTCACTATGTTACCCAGGCTGGTTTCAAACT

CCTGGCCTCATGGGATTCTCCAGCCTCAGTCTCCCAAAGTGCTGGGATTACAGAATCC

AGGAGTCCTCCAG
```

Expression of *Homo sapiens* Interleukin 6 Receptor (IL6R) HSI6REC Transcripts Which Are Detectable By Amplicon as Depicted in Sequence Name HSI6REC Junc10-16-18 (SEQ ID NO:468) in Norman and Cancerous Colon Tissues:

Expression of *Homo sapiens* interleukin 6 receptor (IL6R) transcripts detectable by or according to junc10-16-18, HSI6REC junc10-16-18 (SEQ ID NO:468) amplicon(s) and primers HSI6REC junc10-16-18F (SEQ ID NO:466) and HSI6RECjunc10-16-18R (SEQ ID NO:467) was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1—amplicon (SEQ ID NO:437)), SDHA (GenBank Accession No. NM_004168 (SEQ ID NO:462); amplicon—SDHA-amplicon (SEQ ID NO:465)), G6PD (GenBank Accession No. NM_000402 (SEQ ID NO:442); G6PD amplicon (SEQ ID NO:445)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 41, 52, 62-67, 69-71, Table 2_3, "Tissue samples in colon cancer testing panel"), to obtain a value of fold differential expression for each sample relative to median of the normal PM samples.

Figure 6:
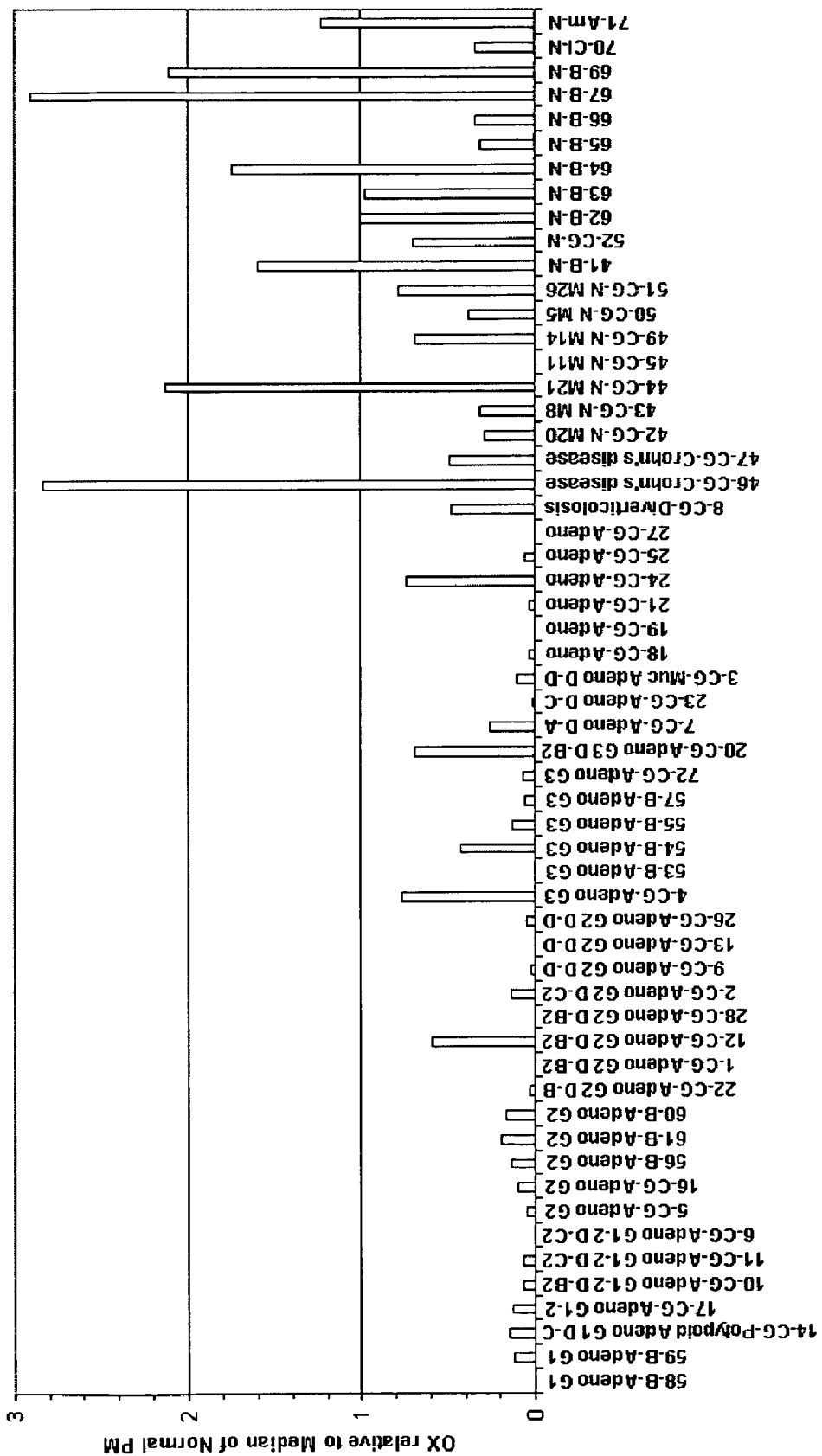
FIG. 6 is a histogram showing down regulation of the *Homo sapiens* interleukin 6 receptor (IL6R) HSI6REC transcripts which are detectable by amplicon as depicted in sequence name HSI6REC junc10-16-18 (SEQ ID NO:468) in cancerous colon samples relative to the normal samples.

FIG. 6 is a histogram showing down regulation of the above-indicated *Homo sapiens* interleukin 6 receptor (IL6R) transcripts in cancerous colon samples relative to the normal samples.

As is evident from FIG. 6, the expression of *Homo sapiens* interleukin 6 receptor (IL6R) transcripts detectable by the above amplicon(s) in cancer samples was significantly lower than in the non-cancerous samples (Sample Nos. 41, 52, 62-67, 69-71 Table 2_3, "Tissue samples in colon cancer testing panel").

Statistical analysis was applied to verify the significance of these results, as described below.

The P value for the difference in the expression levels of *Homo sapiens* interleukin 6 receptor (IL6R) transcripts detectable by the above amplicon(s) in colon cancer samples versus the normal tissue samples was determined by T test as 1.92E-03. This value demonstrates statistical significance of the results.

Primer pairs are also optionally and preferably encompassed within the present invention;

for example, for the above experiment, the following primer pair was used as a non-limiting illustrative example only of a suitable primer pair: HSI6REC junc10-16-18F (SEQ ID NO:466) forward primer; and HSI6RECjunc10-16-18R (SEQ ID NO:467) reverse primer.

The present invention also preferably encompasses any amplicon obtained through the use of any suitable primer pair; for example, for the above experiment, the following amplicon was obtained as a non-limiting illustrative example only of a suitable amplicon: HSI6REC junc10-16-18 (SEQ ID NO:468).

Primers:

```
Forward primer HSI6REC junc10-16-18F (SEQ ID NO: 466):
TCGTGCCCAGGAGGAGTTC

Reverse primer HSI6REC junc10-16-18R (SEQ ID NO: 467):
CTGGAGGACTCCTGGATTCTGTAA

Amplicon HSI6REC junc10-16-18 (SEQ ID NO: 468):
TCGTGCCCAGGAGGAGTTCGGGCAAGGCGAGTGGAGCGAGTGGAGCCCGGAGGCCA

TGGGCACGCCTTGGACAGAGATGAGGTCTCACTATGTTACCCAGGCTGGTTTCAAACT

CCTGGCCTCATGGGATTCTCCAGCCTCAGTCTCCCAAAGTGCTGGGATTACAGAATCC

AGGAGTCCTCCAG
```

Expression of *Homo sapiens* Interleukin 6 Receptor (IL6R) HSI6REC Transcripts Which Are Detectable By Amplicon as Depicted in Sequence Name HSI6REC Junc10-16-18 (SEQ ID NO:468) in Normal and Cancerous Lung Tissues:

Expression of *Homo sapiens* interleukin 6 receptor (IL6R) transcripts detectable by or according to junc10-16-18, HSI6REC junc10-16-18 (SEQ ID NO:468) amplicon(s) and primers HSI6REC junc10-16-18F (SEQ ID NO:466) and HSI6REC junc10-16-18R (SEQ ID NO:467) was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1—amplicon (SEQ ID NO:437)), Ubiquitin (GenBank Accession No. BC000449 (SEQ ID NO:458); amplicon—Ubiquitin-amplicon (SEQ ID NO:461)) and SDHA (GenBank Accession No. NM_004168 (SEQ ID NO:462); amplicon—SDHA-amplicon (SEQ ID NO:465)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2_4, "Tissue samples in lung cancer testing panel"). Then the reciprocal of this ratio was calculated, to obtain a value of fold down-regulation for each sample relative to median of the normal PM samples.

Figure 7:
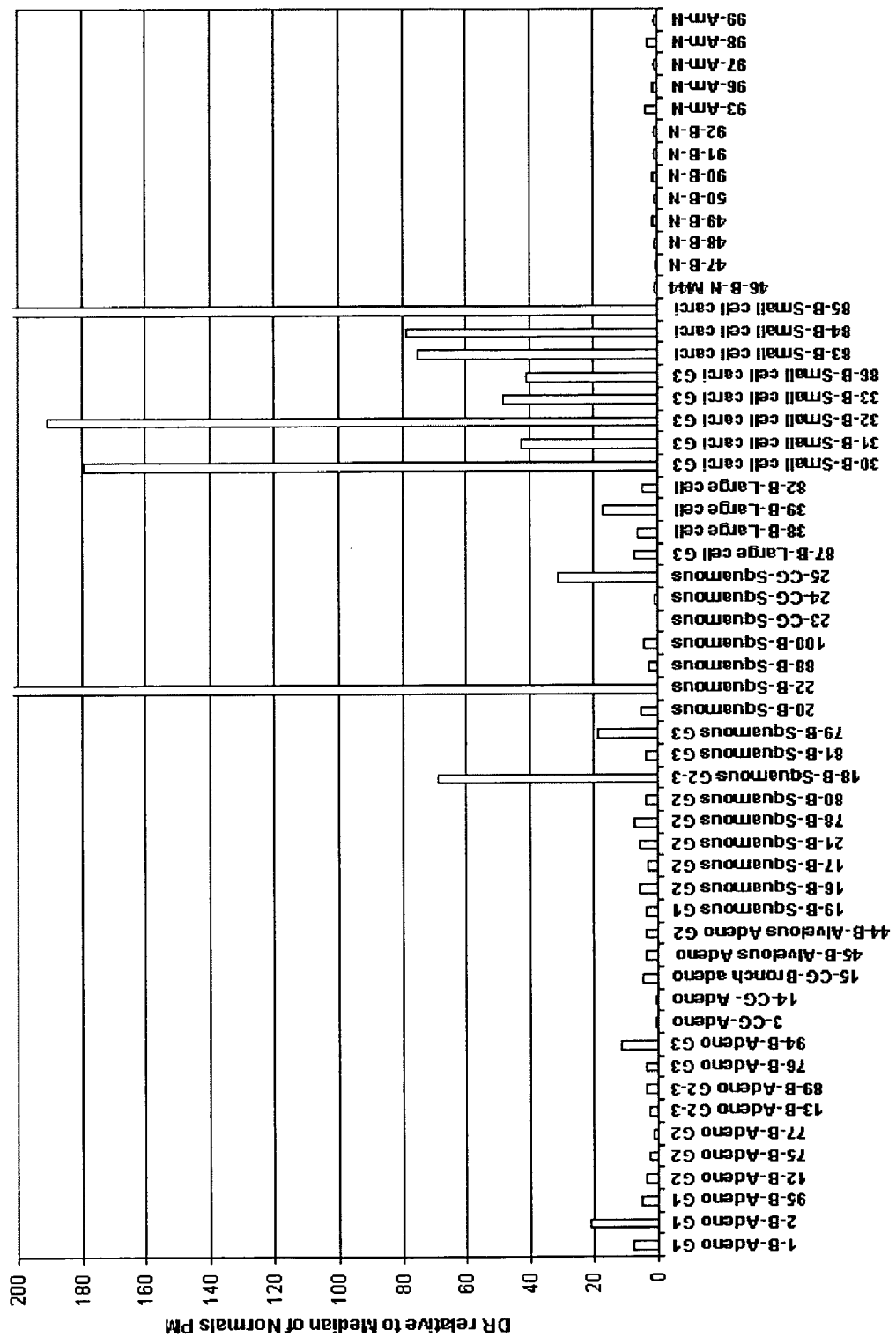
FIG. 7 is a histogram showing down regulation of the *Homo sapiens* interleukin 6 receptor (IL6R) HSI6REC transcripts which are detectable by amplicon as depicted in sequence name HSI6REC junc10-16-18 (SEQ ID NO:468) in cancerous lung samples relative to the normal samples.

FIG. 7 is a histogram showing down regulation of the above-indicated *Homo sapiens* interleukin 6 receptor (IL6R) transcripts in cancerous lung samples relative to the normal samples.

As is evident from FIG. 7, the expression of *Homo sapiens* interleukin 6 receptor (IL6R) transcripts detectable by the above amplicon(s) in cancer samples was significantly lower than in the non-cancerous samples (Sample Nos. 46-50, 90-93, 96-99 Table 2_4, "Tissue samples in lung cancer testing panel"). Notably down regulation of at least 40 fold was found in 8 out of 8 small cells carcinoma samples Statistical analysis was applied to verify the significance of these results, as described below.

The P value for the difference in the expression levels of *Homo sapiens* interleukin 6 receptor (IL6R) transcripts detectable by the above amplicon(s) in small cell lung cancer samples versus the normal tissue samples was determined by T test as 5.22E-03.

Threshold of 40 fold down regulation was found to differentiate between small cell cancer and normal samples with P value of 7.94E-06 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: HSI6REC junc10-16-18F (SEQ ID NO:466) forward primer; and HSI6REC junc10-16-18R (SEQ ID NO:467) reverse primer.

The present invention also preferably encompasses any amplicon obtained through the use of any suitable primer pair; for example, for the above experiment, the following amplicon was obtained as a non-limiting illustrative example only of a suitable amplicon: HSI6REC junc10-16-18 (SEQ ID NO:468).

Primers:

```
Forward primer HSI6REC junc10-16-18F (SEQ ID NO: 466):
TCGTGCCCAGGAGGAGTTC

Reverse primer HSI6REC junc10-16-18R (SEQ ID NO: 467)):
CTGGAGGACTCCTGGATTCTGTAA Amplicon HSI6REC junc10-16-18 (SEQ ID NO: 468):
TCGTGCCCAGGAGGAGTTCGGGCAAGGCGAGTGGAGCGAGTGGAGCCCGGAGGCCA

TGGGCACGCCTTGGACAGAGATGAGGTCTCACTATGTTACCCAGGCTGGTTTCAAACT

CCTGGCCTCATGGGATTCTCCAGCCTCAGTCTCCCAAAGTGCTGGGATTACAGAATCC

AGGAGTCCTCCAG
```

Expression of *Homo sapiens* Interleukin 6 Receptor (IL6R) HSI6REC Transcripts Which Are Detectable By Amplicon as Depicted in Sequence Name HSI6REC Junc10-16-18 (SEQ ID NO:468) in Different Normal Tissues:

Expression of *Homo sapiens* interleukin 6 receptor (IL6R) transcripts detectable by or according to HSI6REC junc10-16-18 (SEQ ID NO:468) amplicon(s) and primers: HSI6REC junc10-16-18F (SEQ ID NO:466) and HSI6RECjunc10-16-18R (SEQ ID NO:467) was measured by real time PCR. In parallel the expression of four housekeeping genes—RPL19 (GenBank Accession No. NM_000981 (SEQ ID NO:450); RPL19 amplicon (SEQ ID NO:453)), TATA box (GenBank Accession No. NM_003194 (SEQ ID NO:454); TATA amplicon (SEQ ID NO:457)), Ubiquitin (GenBank Accession No. BC000449 (SEQ ID NO:458); amplicon—Ubiquitin-amplicon (SEQ ID NO:461)) and SDHA (GenBank Accession No. NM_004168 (SEQ ID NO:462); amplicon—SDHA-amplicon (SEQ ID NO:465)) was measured similarly. For each RT sample, the expression of the above amplicon was normalized to the geometric mean of the quantities of the housekeeping genes. The normalized quantity of each RT sample was then divided by the median of the quantities of the lung samples (Sample Nos. 15-17 Table 2_6, "Tissue samples in normal panel"), to obtain a value of relative expression of each sample relative to median of the lung samples.

Primers:

```
Forward primer HSI6REC junc10-16-18F (SEQ ID NO: 466):
TCGTGCCCAGGAGGAGTTC

Reverse primer HSI6REC junc10-16-18R (SEQ ID NO: 467):
CTGGAGGACTCCTGGATTCTGTAA

Amplicon HSI6REC junc10-16-18 (SEQ ID NO: 468):
TCGTGCCCAGGAGGAGTTCGGGCAAGGCGAGTGGAGCGAGTGGAGCCCGGAGGCCA

TGGGCACGCCTTGGACAGAGATGAGGTCTCACTATGTTACCCAGGCTGGTTTCAAACT

CCTGGCCTCATGGGATTCTCCAGCCTCAGTCTCCCAAAGTGCTGGGATTACAGAATCC

AGGAGTCCTCCAG
```

Figure 8:
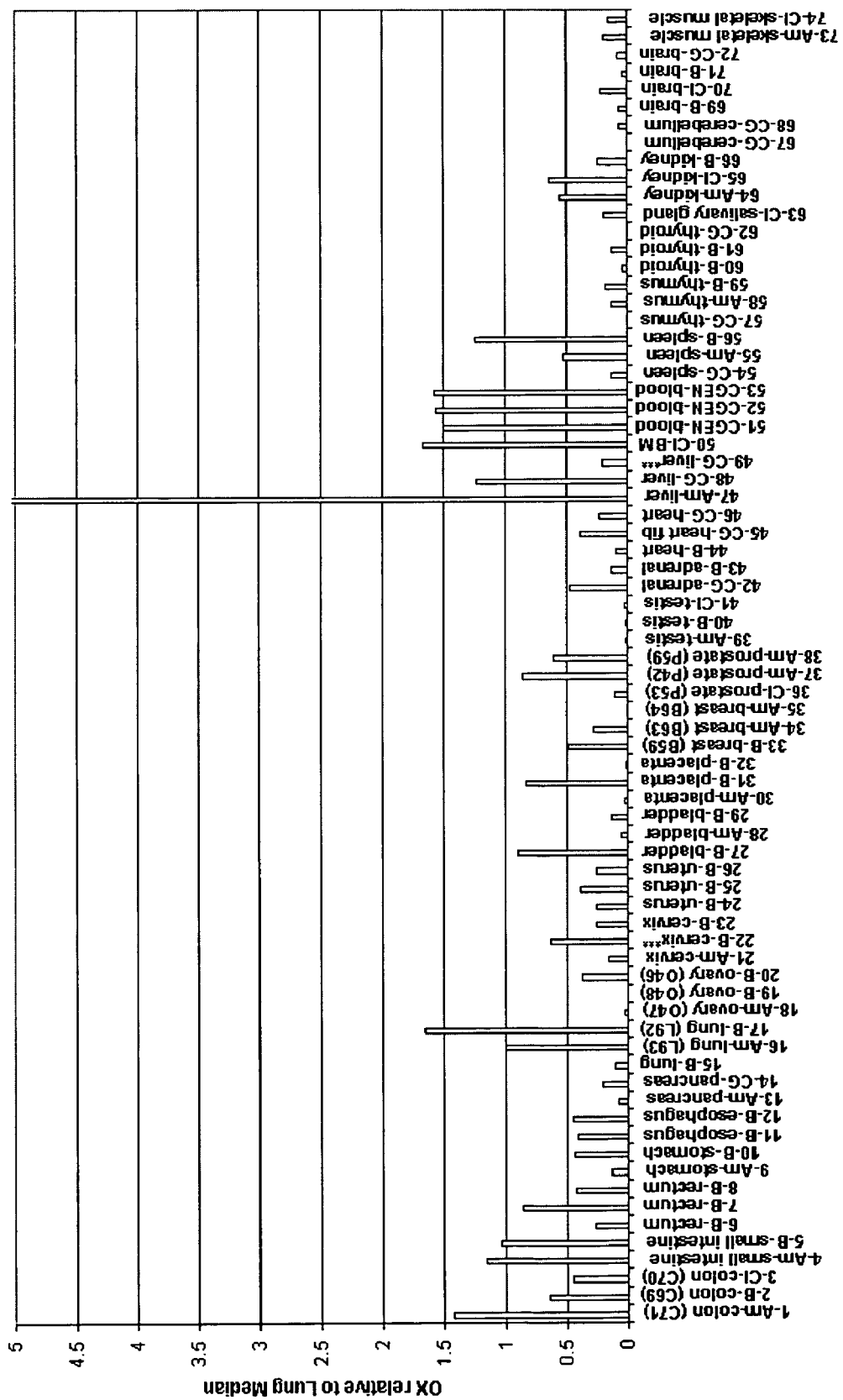
FIG. 8 is a histogram showing the expression of *Homo sapiens* interleukin 6 receptor (IL6R) HSI6REC transcripts which are detectable by amplicon as depicted in sequence name HSI6RECjunc10-16-18 (SEQ ID NO:468) in different normal tissues.

The results are shown in FIG. 8, describing the expression of *Homo sapiens* interleukin 6 receptor (IL6R) HSI6REC transcripts which are detectable by amplicon as depicted in sequence name HSI6RECjunc10-16-18 (SEQ ID NO:468) in different normal tissues.

Expression of *Homo sapiens* Interleukin 6 Receptor (IL6R) HSI6REC Transcripts Which Are Detectable By Amplicon as Depicted in Sequence Name HSI6REC Junc10-16-18 (SEQ ID NO:468) in Normal and Cancerous Ovary Tissues:

Expression of *Homo sapiens* interleukin 6 receptor (IL6R) transcripts detectable by or according to junc10-16-18, HSI6REC junc10-16-18 (SEQ ID NO:468) amplicon(s) and primers HSI6RECjunc10-16-18F (SEQ ID NO:466) and HSI6RECjunc10-16-18R (SEQ ID NO:467) was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1—amplicon (SEQ ID NO:437)), SDHA (GenBank Accession No. NM_004168 (SEQ ID NO:462); amplicon—SDHA-amplicon (SEQ ID NO:465)) and GAPDH (GenBank Accession No. BC026907 (SEQ ID NO:438); GAPDH amplicon (SEQ ID NO:441) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45-48, 71, Table 2_2 above, "Tissue samples in ovarian cancer testing panel"), to obtain a value of fold differential expression for each sample relative to median of the normal PM samples.

In one experiment that was carried out no differential expression in the cancerous samples relative to the normal PM samples was observed. Primer pairs are also optionally and preferably encompassed within the present invention; for example, for the above experiment, the following primer pair was used as a non-limiting illustrative example only of a suitable primer pair: HSI6RECjunc10-16-18F (SEQ ID NO:466) forward primer; and HSI6RECjunc10-16-18R (SEQ ID NO:467) reverse primer.

The present invention also preferably encompasses any amplicon obtained through the use of any suitable primer pair; for example, for the above experiment, the following amplicon was obtained as a non-limiting illustrative example only of a suitable amplicon: HSI6REC junc10-16-18 (SEQ ID NO:468).

Primers:

```
Forward primer HSI6REC junc10-16-18F (SEQ ID NO: 466):
TCGTGCCCAGGAGGAGTTC

Reverse primer HSI6REC junc10-16-18R (SEQ ID NO: 467):
CTGGAGGACTCCTGGATTCTGTAA

Amplicon HSI6REC junc10-16-18 (SEQ ID NO: 468):
TCGTGCCCAGGAGGAGTTCGGGCAAGGCGAGTGGAGCGAGTGGAGCCCGGAGGCCA

TGGGCACGCCTTGGACAGAGATGAGGTCTCACTATGTTACCCAGGCTGGTTTCAAACT

CCTGGCCTCATGGGATTCTCCAGCCTCAGTCTCCCAAAGTGCTGGGATTACAGAATCC

AGGAGTCCTCCAG
```

Expression of *Homo sapiens* Interleukin 6 Receptor (IL6R) HSI6REC Transcripts Which Are Detectable By Amplicon as Depicted in Sequence Name HSI6REC Junc10-16-18 (SEQ ID NO:468) in Normal and Cancerous Prostate Tissues:

Expression of *Homo sapiens* interleukin 6 receptor (IL6R) transcripts detectable by or according to junc10-16-18, HSI6REC junc10-16-18 (SEQ ID NO:468) amplicon(s) and primers HSI6RECjunc10-16-18F (SEQ ID NO:466) and HSI6RECjunc10-16-18R (SEQ ID NO:467) was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1—amplicon (SEQ ID NO:437)), SDHA (GenBank Accession No. NM_004168 (SEQ ID NO:462); amplicon—SDHA-amplicon (SEQ ID NO:465)) and RPL19 (GenBank Accession No. NM_000981 (SEQ ID NO:450); RPL19 amplicon (SEQ ID NO:453)) was measured similarly. For each RT sample, the expression of the above amplicon was normalized to the geometric mean of the quantities of the housekeeping genes.

The normalized quantity of each RT sample was then divided by the median of the quantities of the normal post-mortem (PM) samples (Sample Nos. 42, 48-53, 59-63, Table 2_1, above, "Tissue samples in prostate cancer testing panel"), to obtain a value of fold differential expression for each sample relative to median of the normal PM samples.

In one experiment that was carried out no differential expression in the cancerous samples relative to the normal PM samples was observed.

Primer pairs are also optionally and preferably encompassed within the present invention; for example, for the above experiment, the following primer pair was used as a non-limiting illustrative example only of a suitable primer pair: HSI6REC junc10-16-18F (SEQ ID NO:466) forward primer; and HSI6REC junc10-16-18R (SEQ ID NO:467) reverse primer.

The present invention also preferably encompasses any amplicon obtained through the use of any suitable primer pair; for example, for the above experiment, the following amplicon was obtained as a non-limiting illustrative example only of a suitable amplicon: HSI6REC junc10-16-18 (SEQ ID NO:468).

Primers:

```
Forward primer HSI6REC junc10-16-18F (SEQ ID NO: 466):
TCGTGCCCAGGAGGAGTTC

Reverse primer HSI6REC junc10-16-18R (SEQ ID NO: 467):
CTGGAGGACTCCTGGATTCTGTAA

Amplicon HSI6REC junc10-16-18 (SEQ ID NO: 468):
TCGTGCCCAGGAGGAGTTCGGGCAAGGCGAGTGGAGCGAGTGGAGCCCGGAGGCCA

TGGGCACGCCTTGGACAGAGATGAGGTCTCACTATGTTACCCAGGCTGGTTTCAAACT

CCTGGCCTCATGGGATTCTCCAGCCTCAGTCTCCCAAAGTGCTGGGATTACAGAATCC

AGGAGTCCTCCAG
```

Description for Cluster HSU40434

Cluster HSU40434 features 5 transcript(s) and 37 segment(s) of interest, the names for which are given in Tables 42 and 43, respectively, the sequences themselves are given at the end of the application. The selected protein variants are given in table 44.

TABLE 42

| Transcripts of interest |
| --- |
| Transcript Name |
| HSU40434_T8 (SEQ ID NO: 29) |
| HSU40434_T12 (SEQ ID NO: 30) |
| HSU40434_T15 (SEQ ID NO: 31) |
| HSU40434_T17 (SEQ ID NO: 32) |
| HSU40434_T19 (SEQ ID NO: 33) |

TABLE 43

| Segments of interest |
| --- |
| Segment Name |
| HSU40434_N1 (SEQ ID NO: 34) |
| HSU40434_N17 (SEQ ID NO: 35) |
| HSU40434_N31 (SEQ ID NO: 36) |
| HSU40434_N33 (SEQ ID NO: 37) |
| HSU40434_N58 (SEQ ID NO: 38) |
| HSU40434_N0 (SEQ ID NO: 39) |
| HSU40434_N2 (SEQ ID NO: 40) |

TABLE 43-continued

| Segments of interest |
| --- |
| Segment Name |
| HSU40434_N3 (SEQ ID NO: 41) |
| HSU40434_N7 (SEQ ID NO: 42) |
| HSU40434_N8 (SEQ ID NO: 43) |
| HSU40434_N10 (SEQ ID NO: 44) |
| HSU40434_N13 (SEQ ID NO: 45) |
| HSU40434_N14 (SEQ ID NO: 46) |
| HSU40434_N19 (SEQ ID NO: 47) |
| HSU40434_N21 (SEQ ID NO: 48) |
| HSU40434_N22 (SEQ ID NO: 49) |
| HSU40434_N24 (SEQ ID NO: 50) |
| HSU40434_N25 (SEQ ID NO: 51) |
| HSU40434_N27 (SEQ ID NO: 52) |
| HSU40434_N29 (SEQ ID NO: 53) |
| HSU40434_N36 (SEQ ID NO: 54) |
| HSU40434_N37 (SEQ ID NO: 55) |
| HSU40434_N38 (SEQ ID NO: 56) (called also HSU40434seg 37) |
| HSU40434_N39 (SEQ ID NO: 57) (called also HSU40434seg 38) |
| HSU40434_N40 (SEQ ID NO: 58) |
| HSU40434_N41 (SEQ ID NO: 59) |

TABLE 43-continued

| Segments of interest |
| --- |
| Segment Name |
| HSU40434_N42 (SEQ ID NO: 60) |
| HSU40434_N43 (SEQ ID NO: 61) |
| HSU40434_N44 (SEQ ID NO: 62) |
| HSU40434_N45 (SEQ ID NO: 63) |
| HSU40434_N48 (SEQ ID NO: 64) |
| HSU40434_N49 (SEQ ID NO: 65) |
| HSU40434_N52 (SEQ ID NO: 66) |
| HSU40434_N53 (SEQ ID NO: 67) |
| HSU40434_N54 (SEQ ID NO: 68) |
| HSU40434_N55 (SEQ ID NO: 69) |
| HSU40434_N57 (SEQ ID NO: 70) |

TABLE 44

| Proteins of interest | |
| --- | --- |
| Protein Name | Corresponding Transcript(s) |
| HSU40434_P7 (SEQ ID NO: 80) | HSU40434_T8 (SEQ ID NO: 29) |
| HSU40434_P11 (SEQ ID NO: 81) | HSU40434_T12 (SEQ ID NO: 30) |
| HSU40434_P14 (SEQ ID NO: 82) | HSU40434_T15 (SEQ ID NO: 31) |
| HSU40434_P16 (SEQ ID NO: 83) | HSU40434_T17 (SEQ ID NO: 32) |
| HSU40434_P18 (SEQ ID NO: 84) | HSU40434_T19 (SEQ ID NO: 33) |

These sequences are variants of the known protein Mesothelin precursor (SEQ ID NO:71) (SwissProt accession identifier MSLN_HUMAN (SEQ ID NO:592); known also according to the synonyms CAK1 antigen), referred to herein as the previously known protein.

Protein Mesothelin precursor (SEQ ID NO:71) is known or believed to have the following function(s): May play a role in cellular adhesion. Antigenic protein reactive with antibody K1. The sequence for protein Mesothelin precursor (SEQ ID NO:71) is given at the end of the application, as "Mesothelin precursor (SEQ ID NO:71) amino acid sequence". Protein Mesothelin precursor (SEQ ID NO:71) localization is believed to be Attached to the membrane by a GPI-anchor Not shed to the serum of cancer patients.

The following GO Annotation(s) apply to the previously known protein. The following annotation(s) were found: cell adhesion, which are annotation(s) related to Biological Process; and membrane, which are annotation(s) related to Cellular Component.

The GO assignment relies on information from one or more of the SwissProt/TremB1 Protein knowledgebase, available from <http://www.expasy.ch/sprot/>; or Locuslink, available from <http://www.ncbi.nlm.nih.gov/projects/LocusLink/>.

Cluster HSU40434 can be used as a diagnostic marker according to overexpression of transcripts of this cluster in cancer. Expression of such transcripts in normal tissues is also given according to the previously described methods. The term "number" in the left hand column of the table and the numbers on the y-axis of the figure below refer to weighted expression of ESTs in each category, as "parts per million" (ratio of the expression of ESTs for a particular cluster to the expression of all ESTs in that category, according to parts per million).

Figure 9:
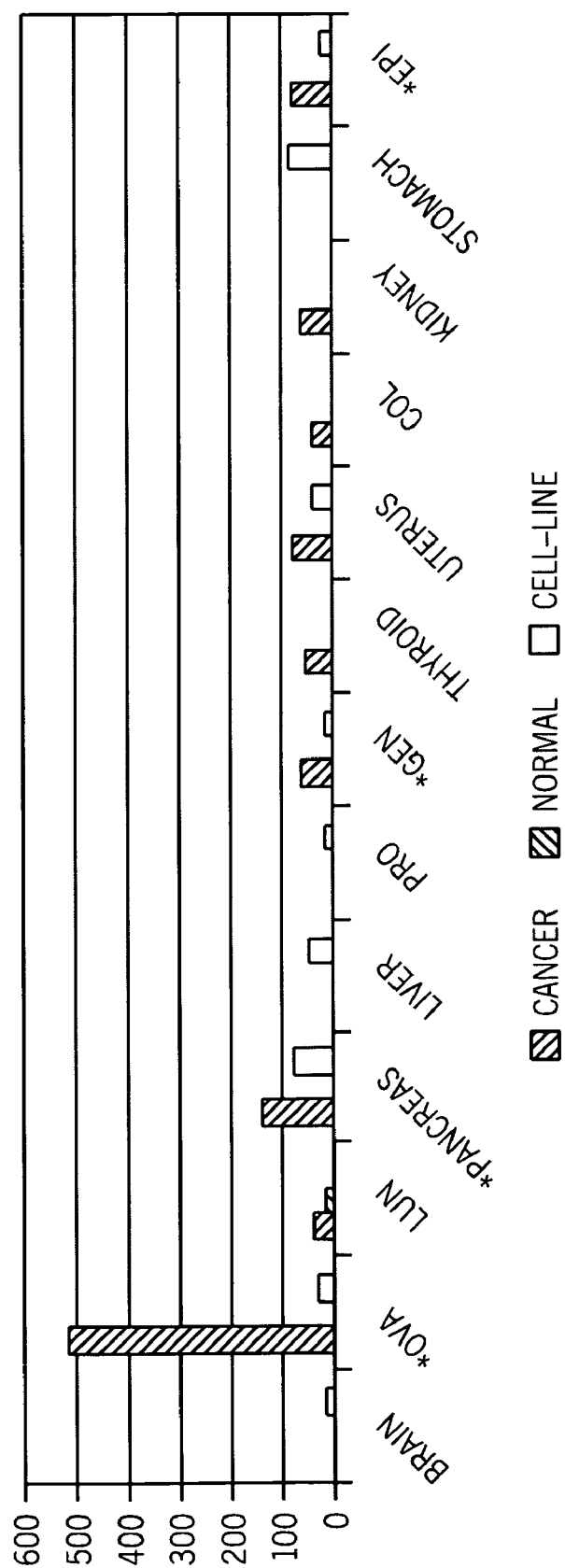
FIG. 9 is a histogram showing Cancer and cell-line vs. normal tissue expression for Cluster HSU40434, demonstrating overexpression in epithelial malignant tumors, a mixture of malignant tumors from different tissues, ovarian carcinoma and pancreas carcinoma.

Overall, the following results were obtained as shown with regard to the histograms in FIG. 9 and Table 45. This cluster is overexpressed (at least at a minimum level) in the following pathological conditions: ovarian carcinoma, pancreas carcinoma, a mixture of malignant tumors from different tissues and epithelial malignant tumors.

TABLE 45

| Normal tissue distribution | |
|---|---|
| Name of Tissue | Number |
| brain | 3 |
| ovary | 0 |
| lung | 22 |
| pancreas | 2 |
| liver | 0 |
| prostate | 1 |
| general | 4 |
| Thyroid | 0 |
| uterus | 4 |
| colon | 0 |
| kidney | 0 |
| stomach | 0 |
| epithelial | 7 |

TABLE 46

| P values and ratios for expression in cancerous tissue | | | | | | |
|---|---|---|---|---|---|---|
| Name of Tissue | P1 | P2 | SP1 | R3 | SP2 | R4 |
| brain | 6.5e−01 | 4.9e−01 | 1.0e+00 | 0.8 | 3.1e−01 | 2.1 |
| ovary | 8.2e−02 | 6.3e−02 | 7.6e−06 | 10.7 | 2.1e−04 | 7.7 |
| lung | 7.6e−01 | 8.9e−01 | 3.3e−01 | 1.7 | 7.1e−01 | 0.9 |
| pancreas | 2.1e−01 | 7.0e−02 | 1.8e−04 | 5.4 | 2.4e−04 | 6.1 |
| liver | N/A | 6.9e−01 | N/A | N/A | 4.8e−01 | 1.9 |

TABLE 46-continued

| P values and ratios for expression in cancerous tissue | | | | | | |
|---|---|---|---|---|---|---|
| Name of Tissue | P1 | P2 | SP1 | R3 | SP2 | R4 |
| prostate | 9.7e−01 | 9.2e−01 | N/A | N/A | 7.5e−01 | 1.2 |
| general | 1.4e−04 | 3.6e−05 | 1.6e−24 | 12.5 | 4.2e−18 | 8.2 |
| Thyroid | 5.7e−01 | 5.7e−01 | 6.8e−01 | 1.5 | 6.8e−01 | 1.5 |
| uterus | 6.9e−02 | 4.0e−02 | 8.4e−02 | 3.4 | 1.1e−01 | 2.9 |
| colon | 1.2e−01 | 1.1e−01 | 3.4e−01 | 2.4 | 4.5e−01 | 2.0 |
| kidney | 3.1e−01 | 4.0e−01 | 1.1e−01 | 3.2 | 2.3e−01 | 2.3 |
| stomach | N/A | 2.6e−01 | N/A | N/A | 2.0e−01 | 2.3 |
| epithelial | 6.0e−03 | 2.7e−03 | 2.6e−12 | 7.7 | 1.6e−08 | 5.3 |

As noted above, cluster HSU40434 features 5 transcript(s), which were listed in Table 42 above. These transcript(s) encode for protein(s) which are variant(s) of protein Mesothelin precursor (SEQ ID NO:71). A description of each variant protein according to the present invention is now provided.

Variant protein HSU40434_P7 (SEQ ID NO:80) according to the present invention has an amino acid sequence as given at the end of the application; it is encoded by transcript(s) HSU40434_T8 (SEQ ID NO:29). An alignment is given to the known protein (Mesothelin precursor (SEQ ID NO:71)) at the end of the application. One or more alignments to one or more previously published protein sequences are given at the end of the application. A brief description of the relationship of the variant protein according to the present invention to each such aligned protein is as follows:

1. Comparison Report Between HSU40434_P7 (SEQ ID NO:80) and Q14859_HUMAN (SEQ ID NO:74):

A. An isolated chimeric polypeptide encoding for HSU40434_P7 (SEQ ID NO:80), comprising a amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLL-PRLVSCPGPLDQDQQEAARAALQGGGPPYGPPSTWS VSTMDALRGLLPVLGQPIIRSIPQ-GIVAAWRQRSSRDPSWRQPERTILR-PRFRREVEKTACP SGKKAREIDESLIFYKKWE-LEACVDAALLATQMDRVNAIPFTYEQLDVLKHKLDE LYPQG YPESVIQHLGYLFLKMSPEDIRKWNVTS-LETLKALLEVNKGHEMSPQVATLIDRFVKGRG QLD-KDTLDTLTAFYPGYLCSLSPEELSSVPPSSIW corresponding to amino acids 1-458 of Q14859_HUMAN (SEQ ID NO:74), which also corresponds to amino acids 1-458 of HSU40434_P7 (SEQ ID NO:80), wherein said and first amino acid sequence are contiguous and in a sequential order.

2. Comparison Report Between HSU40434_P7 (SEQ ID NO:80) and Q96KJ5_HUMAN (SEQ ID NO:79):

A. An isolated chimeric polypeptide encoding for HSU40434_P7 (SEQ ID NO:80), comprising a amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLL-PRLVSCPGPLDQDQQEAARAALQGGGPPYGPPSTWS VSTMDALRGLLPVLGQPIIRSIPQ-
GIVAAWRQRSSRDPSWRQPERTILR-
PRFRREVEKTACP SGKKAREIDESLIFYKKWE-
LEACVDAALLATQMDRVNAIPFTYEQLDVLKHKLDE
LYPQG YPESVIQHLGYLFLKMSPEDIRKWNVTS-
LETLKALLEVNKGHEMSPQVATLIDRFVKGRG QLD-
KDTLDTLTAFYPGYLCSLSPEELSSVPPSSIW corresponding to amino acids 1-458 of Q96KJ5_HUMAN (SEQ ID NO:79), which also corresponds to amino acids 1-458 of HSU40434_P7 (SEQ ID NO:80), wherein said and first amino acid sequence are contiguous and in a sequential order.

3. Comparison Report Between HSU40434_P7 (SEQ ID NO:80) and NP_005814 (SEQ ID NO:78):

A. An isolated chimeric polypeptide encoding for HSU40434_P7 (SEQ ID NO:80), comprising a amino acid sequence being at least 90% homologous to MALPTAR-
PLLGSCGTPALGSLLFLLFSLG-
WVQPSRTLAGETGQEAAPLDGVLANPPNISSL
SPRQLLGFPCAEVSGLSTERVRELAVA-
LAQKNVKLSTEQLRCLAHRLSEPPEDLDALPLDL
LLFLNPDAFSGPQACTRFFSRITKAN-
VDLLPRGAPERQRLLPAALACWGVRGSLLSEADV
RALGGLACDLPGRFVAESAEVLL-
PRLVSCPGPLDQDQQEAARAALQGGGPPYGPPSTWS
VSTMDALRGLLPVLGQPIIRSIPQ-
GIVAAWRQRSSRDPSWRQPERTILR-
PRFRREVEKTACP SGKKAREIDESLIFYKKWE-
LEACVDAALLATQMDRVNAIPFTYEQLDVLKHKLDE
LYPQG YPESVIQHLGYLFLKMSPEDIRKWNVTS-
LETLKALLEVNKGHEMSPQVATLIDRFVKGRG QLD-
KDTLDTLTAFYPGYLCSLSPEELSSVPPSSIW corresponding to amino acids 1-458 of NP_005814 (SEQ ID NO:78), which also corresponds to amino acids 1-458 of HSU40434_P7 (SEQ ID NO:80), wherein said and first amino acid sequence are contiguous and in a sequential order.

4. Comparison Report Between HSU40434_P7 (SEQ ID NO:80) and Q96GR6_HUMAN (SEQ ID NO:72):

A. An isolated chimeric polypeptide encoding for HSU40434_P7 (SEQ ID NO:80), comprising a first amino acid sequence being at least 90% homologous to MALPTAR-
PLLGSCGTPALGSLLFLLFSLG-
WVQPSRTLAGETGQEAAPLDGVLANPPNISSL
SPRQLLGFPCAEVSGLSTERVRELAVA-
LAQKNVKLSTEQLRCLAHRLSEPPEDLDALPLDL
LLFLNPDAFSGPQACTRFFSRITKAN-
VDLLPRGAPERQRLLPAALACWGVRGSLLSEADV
RALGGLACDLPGRFVAESAEVLL-
PRLVSCPGPLDQDQQEAARAALQGGGPPYGPPSTWS
VSTMDALRGLLPVLGQPIIRSIPQ-
GIVAAWRQRSSRDPSWRQPERTILR-
PRFRREVEKTACP SGKKA corresponding to amino acids 1-308 of Q96GR6_HUMAN (SEQ ID NO:72), which also corresponds to amino acids 1-308 of HSU40434_P7 (SEQ ID NO:80), a bridging amino acid R corresponding to amino acid 309 of HSU40434_P7 (SEQ ID NO:80), and a second amino acid sequence being at least 90% homologous to EIDESLI-
FYKKWELEACVDAALLATQM-
DRVNAIPFTYEQLDVLKHKLDELYPQGYPESVI
QHLGYLFLKMSPEDIRKWNVTSLETLKA-
LLEVNKGHEMSPQVATLIDRFVKGRGQLDKD
TLDTLTAFYPGYLCSLSPEELSSVPPSSIW corresponding to amino acids 310-458 of Q96GR6_HUMAN (SEQ ID NO:72), which also corresponds to amino acids 310-458 of HSU40434_P7 (SEQ ID NO:80), wherein said first amino acid sequence, bridging amino acid and second amino acid sequence are contiguous and in a sequential order.

5. Comparison Report Between HSU40434_P7 (SEQ ID NO:80) and Q9BTR2_HUMAN (SEQ ID NO:75):

A. An isolated chimeric polypeptide encoding for HSU40434_P7 (SEQ ID NO:80), comprising a first amino acid sequence being at least 90% homologous to MALPTAR-
PLLGSCGTPALGSLLFLLFSLGWVQPSRTLAGETGQ
corresponding to amino acids 1-43 of Q9BTR2_HUMAN (SEQ ID NO:75), which also corresponds to amino acids 1-43 of HSU40434_P7 (SEQ ID NO:80), a bridging amino acid E corresponding to amino acid 44 of HSU40434_P7 (SEQ ID NO:80), and a third amino acid sequence being at least 90% homologous to AAPLDGVLANPPNISSLSPRQLLGFP-
CAEVSGLSTERVRELAVALAQKNVKLSTEQLRCLA
HRLSEPPEDLDALPLDLLLFLNPDAFSG-
PQACTRFFSRITKANVDLLPRGAPERQRLLPAAL
ACWGVRGSLLSEADVRALGGLACDLPGR-
FVAESAEVLLPRLVSCPGPLDQDQQEAARAA
LQGGGPPYGPPSTWSVSTMDALRGLLPV-
LGQPIIRSIPQGIVAAWRQRSSRDPSWRQPERTI
LRPRFRREVEKTACPSGKKAREIDESLI-
FYKKWELEACVDAALLATQMDRVNAIPFTYEQ LDV-
LKHKLDELYPQGYPESVIQHLGYLFLKM-
SPEDIRKWNVTSLETLKALLEVNKGHEMS
PQVATLIDRFVKGRGQLDKDTLDTL-
TAFYPGYLCSLSPEELSSVPPSSIW corresponding to amino acids 44-457 of Q9BTR2_HUMAN (SEQ ID NO:75), which also corresponds to amino acids 45-458 of HSU40434_P7 (SEQ ID NO:80), wherein said first amino acid sequence, second amino acid sequence and third amino acid sequence are contiguous and in a sequential order.

6. Comparison Report Between HSU40434_P7 (SEQ ID NO:80) and NP_037536 (SEQ ID NO:76):

A. An isolated chimeric polypeptide encoding for HSU40434_P7 (SEQ ID NO:80), comprising a first amino acid sequence being at least 90% homologous to MALPTAR-
PLLGSCGTPALGSLLFLLFSLG-
WVQPSRTLAGETGQEAAPLDGVLANPPNISSL
SPRQLLGFPCAEVSGLSTERVRELAVA-
LAQKNVKLSTEQLRCLAHRLSEPPEDLDALPLDL
LLFLNPDAFSGPQACTRFFSRITKAN-
VDLLPRGAPERQRLLPAALACWGVRGSLLSEADV
RALGGLACDLPGRFVAESAEVLL-
PRLVSCPGPLDQDQQEAARAALQGGGPPYGPPSTWS
VSTMDALRGLLPVLGQPIIRSIPQ-
GIVAAWRQRSSRDPSWRQPERTILR-
PRFRREVEKTACP SGKKAREIDESLIFYKKWE-
LEACVDAALLATQMDRVNAIPFTYEQLDVLKHKLDE
LYPQG YPESVIQHLGYLFLKMSPEDIRKWNVTS-
LETLKALLEVNKGHEMSPQ corresponding to amino acids 1-410 of NP_037536 (SEQ ID NO:76), which also corresponds to amino acids 1-410 of HSU40434_P7 (SEQ ID NO:80), and a second amino acid sequence being at least 90% homologous to VATLIDRFVKGRGQLDKDTLDTL-
TAFYPGYLCSLSPEELSSVPPSSIW corresponding to amino acids 419-466 of NP_037536 (SEQ ID NO:76), which also corresponds to amino acids 411-458 of HSU40434_P7 (SEQ ID NO:80), wherein said first amino acid sequence and second amino acid sequence are contiguous and in a sequential order.

B. An isolated chimeric polypeptide encoding for an edge portion of HSU40434_P7 (SEQ ID NO:80), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 410-x to 410; and ending at any of amino acid numbers 411+((n−2)−x), in which x varies from 0 to n−2.

7. Comparison Report Between HSU40434_P7 (SEQ ID NO:80) and Q9BR17_HUMAN (SEQ ID NO:73):

A. An isolated chimeric polypeptide encoding for HSU40434_P7 (SEQ ID NO:80), comprising a first amino acid sequence being at least 90% homologous to MALPTARPLLGSCGTPALGSLLFLLFSLG-WVQPSRTLAGETGQEAAPLDGVLANPPNISSLSPRQLLGFPCAEVSGLSTERVRELAVA-LAQKNVKLSTEQLRCLAHRLSEPPEDLDALPLDLLLFLNPDAFSGPQACTRFFSRITKAN-VDLLPRGAPERQRLLPAALACWGVRGSLLSEADVRALGGLACDLPGRFVAESAEVLL-PRLVSCPGPLDQDQQEAARAALQGGGPPYGPPSTWSVSTMDALRGLLPVLGQPIIRSIPQ-GIVAAWRQRSSRDPSWRQPERTILR-PRFRREVEKTACP SGKKAREIDESLIFYKKWE-LEACVDAALLATQMDRVNAIPFTYEQLDVLKHKLD-ELYPQG YPESVIQHLGYLFLKMSPEDIRKWNVTS-LETLKALLEVNKGHEMSPQ corresponding to amino acids 1-410 of Q9BR17_HUMAN (SEQ ID NO:73), which also corresponds to amino acids 1-410 of HSU40434_P7 (SEQ ID NO:80), and a second amino acid sequence being at least 90% homologous to VATLIDRFVKGRGQLD-KDTLDTLTAFYPGYLCSLSPEELSSVPPSSIW corresponding to amino acids 419-466 of Q9BR17_HUMAN (SEQ ID NO:73), which also corresponds to amino acids 411-458 of HSU40434_P7 (SEQ ID NO:80), wherein said first amino acid sequence and second amino acid sequence are contiguous and in a sequential order.

B. An isolated chimeric polypeptide encoding for an edge portion of HSU40434_P7 (SEQ ID NO:80), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 410-x to 410; and ending at any of amino acid numbers 411+((n−2)−x), in which x varies from 0 to n−2.

The localization of the variant protein was determined according to results from a number of different software programs and analyses, including analyses from SignalP and other specialized programs. The variant protein is believed to be located as follows with regard to the cell: secreted.

Variant protein HSU40434_P7 (SEQ ID NO:80) also has the following non-silent SNPs (Single Nucleotide Polymorphisms) as listed in Table 47, (given according to their position(s) on the amino acid sequence, with the alternative amino acid(s) listed; the last column indicates whether the SNP is known or not; the presence of known SNPs in variant protein HSU40434_P7 (SEQ ID NO:80) sequence provides support for the deduced sequence of this variant protein according to the present invention).

TABLE 47

| SNP position(s) on amino acid sequence | Alternative amino acid(s) | Previously known SNP? |
|---|---|---|
| 51 | V -> | No |
| 118 | L -> V | No |
| 139 | R -> H | No |
| 162 | L -> Q | No |
| 225 | A -> P | No |
| 225 | A -> S | No |
| 232 | P -> | No |
| 325 | A -> | No |
| 325 | A -> P | No |
| 330 | A -> V | No |
| 342 | I -> N | No |
| 426 | D -> | No |

Amino acid mutations

The glycosylation sites of variant protein HSU40434_P7 (SEQ ID NO:80), as compared to the known protein Mesothelin precursor (SEQ ID NO:71), are described in Table 48 (given according to their position(s) on the amino acid sequence in the first column; the second column indicates whether the glycosylation site is present in the variant protein; and the last column indicates whether the position is different on the variant protein).

TABLE 48

Glycosylation site(s)

| Position(s) on known amino acid sequence | Present in variant protein? | Position(s) on variant protein |
|---|---|---|
| 67 | Yes | 68 |
| 398 | Yes | 399 |
| 494 | No | |
| 521 | No | |

The variant protein has the following domains, as determined by using InterPro. The domains are described in Table 49:

TABLE 49

InterPro domain(s)

| Domain description | Analysis type | Position(s) on protein |
|---|---|---|
| Pre-pro-megakaryocyte potentiating factor precursor | HMMPfam | 1-458 |
| Hemopexin | ScanRegExp | 317-331 |

Variant protein HSU40434_P7 (SEQ ID NO:80) is encoded by the following transcript(s): HSU40434_T8 (SEQ ID NO:29), for which the sequence(s) is/are given at the end of the application. The coding portion of transcript HSU40434_T8 (SEQ ID NO:29) is shown in bold; this coding portion starts at position 419 and ends at position 1792. The transcript also has the following SNPs as listed in Table 50 (given according to their position on the nucleotide sequence, with the alternative nucleic acid listed; the last column indicates whether the SNP is known or not; the presence of known SNPs in variant protein HSU40434_P7 (SEQ ID NO:80) sequence provides support for the deduced sequence of this variant protein according to the present invention).

TABLE 50

Nucleic acid SNPs

| SNP position(s) on nucleotide sequence | Alternative nucleic acid(s) | Previously known SNP? |
|---|---|---|
| 169 | G -> A | Yes |
| 333 | G -> A | Yes |
| 556 | G -> A | No |
| 571 | C -> | No |
| 770 | C -> G | No |
| 834 | G -> A | No |
| 903 | T -> A | No |
| 1091 | G -> C | No |
| 1091 | G -> T | No |
| 1112 | C -> | No |
| 1391 | G -> C | No |
| 1391 | G -> | No |
| 1407 | C -> T | No |
| 1443 | T -> A | No |
| 1695 | A -> | No |
| 1930 | G -> | No |
| 1954 | A -> G | No |
| 2269 | A -> G | No |
| 2430 | G -> A | No |

Variant protein HSU40434_P11 (SEQ ID NO:81) according to the present invention has an amino acid sequence as given at the end of the application; it is encoded by transcript(s) HSU40434_T12 (SEQ ID NO:30). An alignment is given to the known protein (Mesothelin precursor (SEQ ID NO:71)) at the end of the application. One or more alignments to one or more previously published protein sequences are given at the end of the application. A brief description of the relationship of the variant protein according to the present invention to each such aligned protein is as follows:

1. Comparison Report Between HSU40434_P11 (SEQ ID NO:81) and NP_005814 (SEQ ID NO:78):

A. An isolated chimeric polypeptide encoding for HSU40434_P11 (SEQ ID NO:81), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLLPRL corresponding to amino acids 1-208 of NP_005814 (SEQ ID NO:78), which also corresponds to amino acids 1-208 of HSU40434_P11 (SEQ ID NO:81), and a second amino acid sequence being at least 90% homologous to GIVAAWRQRSS-RDPSWRQPERTILRPRFRREVEKTACPS-GKKAREIDESLIFYKKWELEAC VDAALLATQM-DRVNAIPFTYEQLDVLKHKLDELYPQGYPESVIQHLG YLFLKMSPEDIRK WNVTSLETLKALLEVNKGHEM-SPQVATLIDRFVKGRGQLDKDTLDTL-TAFYPGYLCSLSP EELSSVPPSSIWAVRPQDLDTCD-PRQLDVLYPKARLAFQNMNGSEYFVKIQSFLGGAPT-ED LKALSQQNVSMDLATFMKLRTDAVLPLT-VAEVQKLLGPHVEGLKAEERHRPVRDWILRQ RQD-DLDTLGLGLQGGIPNGYLVLDLSM-QEALSGTPCLLGPGPVLTVLALLLASTLA corresponding to amino acids 266-622 of NP_005814 (SEQ ID NO:78), which also corresponds to amino acids 209-565 of HSU40434_P11 (SEQ ID NO:81), wherein said first amino acid sequence and second amino acid sequence are contiguous and in a sequential order.

B. An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n-2)-x), in which x varies from 0 to n-2.

2. Comparison Report Between HSU40434_P11 (SEQ ID NO:81) and Q96KJ5_HUMAN (SEQ ID NO:79):

A. An isolated chimeric polypeptide encoding for HSU40434_P11 (SEQ ID NO:81), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLLPRL corresponding to amino acids 1-208 of Q96KJ5_HUMAN (SEQ ID NO:79), which also corresponds to amino acids 1-208 of HSU40434_P11 (SEQ ID NO:81), and a second amino acid sequence being at least 90% homologous to GIVAAWRQRSSRDPSWRQPERTILR-PRFRREVEKTACPSGKKAREIDESLIFYKKWELEAC VDAALLATQMDRVNAIPFTYEQLDVLKH-KLDELYPQGYPESVIQHLGYLFLKMSPEDIRK WNVTSLETLKALLEVNKGHEMSPQ-VATLIDRFVKGRGQLDKDTLDTLTAFYPGYLCSLSP EELSSVPPSSIWAVRPQDLDTCDPRQLD-VLYPKARLAFQNMNGSEYFVKIQSFLGGAPTED LKALSQQNVSMDLATFMKLRTDAVLPLT-VAEVQKLLGPHVEGLKAEERHRPVRDWILRQ RQD-DLDTLGLGLQGGIPNGYLVLDLSM-QEALSGTPCLLGPGPVLTVLALLLASTLA corresponding to amino acids 266-622 of Q96KJ5_HUMAN (SEQ ID NO:79), which also corresponds to amino acids 209-565 of HSU40434_P11 (SEQ ID NO:81), wherein said first amino acid sequence and second amino acid sequence are contiguous and in a sequential order.

B. An isolated chimeric polypeptide encoding for an edge portion of HSU40434_P 11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n-2)-x), in which x varies from 0 to n-2.

3. Comparison Report Between HSU40434_P11 (SEQ ID NO:81) and Q96GR6_HUMAN (SEQ ID NO:72):

A. An isolated chimeric polypeptide encoding for HSU40434_P11 (SEQ ID NO:81), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLLPRL corresponding to amino acids 1-208 of Q96GR6_HUMAN (SEQ ID NO:72), which also corresponds to amino acids 1-208 of HSU40434_P11 (SEQ ID NO:81), a second amino acid sequence being at least 90% homologous to GIVAAWRQRSSRDPSWRQPERTILR-PRFRREVEKTACPSGKKA corresponding to amino acids 266-308 of Q96GR6_HUMAN (SEQ ID NO:72), which also corresponds to amino acids 209-251 of HSU40434_P11 (SEQ ID NO:81), a bridging amino acid R corresponding to amino acid 252 of HSU40434_P11 (SEQ ID NO:81), and a third amino acid sequence being at least 90% homologous to EIDESLIFYKKWELEACVDAALLATQM-DRVNAIPFTYEQLDVLKHKLDELYPQGYPESVI QHLGYLFLKMSPEDIRKWNVTSLETLKA-LLEVNKGHEMSPQVATLIDRFVKGRGQLDKD TLDTLTAFYPGYLCSLSPEELSS-VPPSSIWAVRPQDLDTCDPRQLDVLYP-KARLAFQNMNG SEYFVKIQSFLGGAPTEDL-KALSQQNVSMDLATFMKLRTDAVLPLTVAEVQKLLG PHVE GLKAEERHRPVRDWILRQRQD-DLDTLGLGLQGGIPNGYLVLDLSM-QEALSGTPCLLGPGP VLTVLALLLASTLA corresponding to amino acids 310-622 of Q96GR6_HUMAN (SEQ ID NO:72), which also corresponds to amino acids 253-565 of HSU40434_P11 (SEQ ID NO:81), wherein said first amino acid sequence, second amino acid sequence, bridging amino acid and third amino acid sequence are contiguous and in a sequential order.

B. An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n−2)−x), in which x varies from 0 to n−2.

4. Comparison Report Between HSU40434_P11 (SEQ ID NO:81) and Q14859_HUMAN (SEQ ID NO:74):

A. An isolated chimeric polypeptide encoding for HSU40434_P11 (SEQ ID NO:81), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLLPRL corresponding to amino acids 1-208 of Q14859_HUMAN (SEQ ID NO:74), which also corresponds to amino acids 1-208 of HSU40434_P11 (SEQ ID NO:81), a second amino acid sequence being at least 90% homologous to GIVAAWRQRSSRDPSWRQPERTILR-PRFRREVEKTACPSGKKAREIDESLIFYKKWELEAC VDAALLATQMDRVNAIPFTYEQLDVLKH-KLDELYPQGYPESVIQHLGYLFLKMSPEDIRK WNVTSLETLKALLEVNKGHEMSPQ-VATLIDRFVKGRGQLDKDTLDTLTAFYPGYLCSLSP EELSSVPPSSIWAVRPQDLDTCDPRQLD-VLYPKARLAFQNMNGSEYFVKIQSFLGGAPTED LKALSQQNVSMDLATFMKLRTDAVLPLT-VAEVQKLLGPHVEGLKAEERHRPVRDWILRQ RQD-DLDTLGLGLQGGIPNGYLVLDLS corresponding to amino acids 266-592 of Q14859_HUMAN (SEQ ID NO:74), which also corresponds to amino acids 209-535 of HSU40434_P11 (SEQ ID NO:81), a bridging amino acid M corresponding to amino acid 536 of HSU40434_P11 (SEQ ID NO:81), and a third amino acid sequence being at least 90% homologous to QEALSGTPCLLGPGPVLTVLA-LLLASTLA corresponding to amino acids 594-622 of Q14859_HUMAN (SEQ ID NO:74), which also corresponds to amino acids 537-565 of HSU40434_P11 (SEQ ID NO:81), wherein said first amino acid sequence, second amino acid sequence, bridging amino acid and third amino acid sequence are contiguous and in a sequential order.

B. An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n−2)−x), in which x varies from 0 to n−2.

5. Comparison Report Between HSU40434_P11 (SEQ ID NO:81) and Q9BTR2_HUMAN (SEQ ID NO:75):

A. An isolated chimeric polypeptide encoding for HSU40434_P11 (SEQ ID NO:81), comprising a first amino acid sequence being at least 90% homologous to MALPTAR-PLLGSCGTPALGSLLFLLFSLGWVQPSRTLAGETGQ corresponding to amino acids 1-43 of Q9BTR2_HUMAN (SEQ ID NO:75), which also corresponds to amino acids 1-43 of HSU40434_P11 (SEQ ID NO:81), a first bridging amino acid E corresponding to amino acid 44 of HSU40434_P11 (SEQ ID NO:81), a second amino acid sequence being at least 90% homologous to AAPLDGVLANPPNISSLSPRQLLG-FPCAEVSGLSTERVRELAVALAQKNVKLSTEQLRCLA HRLSEPPEDLDALPLDLLLFLNPDAFSG-PQACTRFFSRITKANVDLLPRGAPERQRLLPAAL ACWGVRGSLLSEADVRALGGLACDLPGR-FVAESAEVLLPRL corresponding to amino acids 44-207 of Q9BTR2_HUMAN (SEQ ID NO:75), which also corresponds to amino acids 45-208 of HSU40434_P11 (SEQ ID NO:81), a third amino acid sequence being at least 90% homologous to GIVAAWRQRSSRDPSWRQPERTILR-PRFRREVEKTACPSGKKAREIDESLIFYKKWELEAC VDAALLATQMDRVNAIPFTYEQLDVLKH-KLDELYPQGYPESVIQHLGYLFLKMSPED IRK WNVTSLETLKALLEVNKGHEMSPQ-VATLIDRFVKGRGQLDKDTLDTLTAFYPGYLCSLSP EELSSVPPSSIWAVRPQDLDTCDPRQLD-VLYPKARLAFQNMNGSEYFVKIQSFLGGAPTED LKALSQQNVSMDLATFMKLRTDAVLPLT-VAEVQKLLGPHVEGLKAEERHRPVRDWILRQ RQD-DLDTLGLGLQGGIPNGYLVLDLS corresponding to amino acids 265-591 of Q9BTR2_HUMAN (SEQ ID NO:75), which also corresponds to amino acids 209-535 of HSU40434_P11 (SEQ ID NO:81), a second bridging amino acid M corresponding to amino acid 536 of HSU40434_P11 (SEQ ID NO:81), and a fourth amino acid sequence being at least 90% homologous to QEALSGTPCLLGPGPVLTVLA-LLLASTLA corresponding to amino acids 593-621 of Q9BTR2_HUMAN (SEQ ID NO:75), which also corresponds to amino acids 537-565 of HSU40434_P11 (SEQ ID NO:81), wherein said first amino acid sequence, first bridging amino acid, second amino acid sequence, third amino acid sequence, second bridging amino acid and fourth amino acid sequence are contiguous and in a sequential order.

B. An isolated chimeric polypeptide encoding for an edge portion of HSU40434 P1 1 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n−2)−x), in which x varies from 0 to n−2.

6. Comparison Report Between HSU40434_P11 (SEQ ID NO:81) and NP_037536 (SEQ ID NO:76):

A. An isolated chimeric polypeptide encoding for HSU40434_P11 (SEQ ID NO:81), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLLPRL corresponding to amino acids 1-208 of NP_037536 (SEQ ID NO:76), which also corresponds to amino acids 1-208 of HSU40434_P11 (SEQ ID NO:81), a second amino acid sequence being at least 90% homologous to GIVAAWRQRSSRDPSWRQPERTIL-RPRFRREVEKTACPSGKKAREIDESLIFYKKWELEAC VDAALLATQMDRVNAIPFTYEQLDVLKH-KLDELYPQGYPESVIQHLGYLFLKMSPEDIRK WNVTSLETLKALLEVNKGHEMSPQ corresponding to amino acids 266-410 of NP_037536 (SEQ ID NO:76), which also corresponds to amino acids 209-353 of HSU40434_P11 (SEQ ID NO:81), and a third amino acid sequence being at least 90% homologous to VATLIDRFVKGRGQLD-KDTLDTLTAFYPGYLCSLSPEELSS-VPPSSIWAVRPQDLDTCDPR QLDVLYPKARLAFQNM-NGSEYFVKIQSFLGGAPTEDLKALSQQNVSMDLATF MKLRTDA VLPLTVAEVQKLLGPHVEGLKAEERHR-PVRDWILRQRQDDLDTLGLGLQGGIPNGYLVL DLSMQEALSGTPCLLGPGPVLTVLALLLASTLA corresponding to amino acids 419-630 of NP_037536 (SEQ ID NO:76), which also corresponds to amino acids 354-565 of HSU40434_P11 (SEQ ID NO:81), wherein said first amino acid sequence, second amino acid sequence and third amino acid sequence are contiguous and in a sequential order.

B. An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n−2)−x), in which x varies from 0 to n−2.

C. An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 353-x to 353; and ending at any of amino acid numbers 354+((n−2)−x), in which x varies from 0 to n−2.

7. Comparison Report Between HSU40434_P11 (SEQ ID NO:81) and Q9BR17_HUMAN (SEQ ID NO:73):

A. An isolated chimeric polypeptide encoding for HSU40434_P11 (SEQ ID NO:81), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLLPRL corresponding to amino acids 1-208 of Q9BR17_HUMAN (SEQ ID NO:73), which also corresponds to amino acids 1-208 of HSU40434_P11 (SEQ ID NO:81), a second amino acid sequence being at least 90% homologous to GIVAAWRQRSSRDPSWRQPERTILR-PRFRREVEKTACPSGKKAREIDESLIFYKKWELEAC VDAALLATQMDRVNAIPFTYEQLDVLKH-KLDELYPQGYPESVIQHLGYLFLKMSPEDIRK WNVTSLETLKALLEVNKGHEMSPQ corresponding to amino acids 266-410 of Q9BR17_HUMAN (SEQ ID NO:73), which also corresponds to amino acids 209-353 of HSU40434_P11 (SEQ ID NO:81), and a third amino acid sequence being at least 90% homologous to VATLIDRFVKGRGQLDKDTLDTL-TAFYPGYLCSLSPEELSSVPPSSIWAVRPQDLDTCDPR QLDVLYPKARLAFQNMNGSEYFVKIQS-FLGGAPTEDLKALSQQNVSMDLATFMKLRTDA VLPLTVAEVQKLLGPHVEGLKAEERHR-PVRDWILRQRQDDLDTLGLGLQGGIPNGYLVL DLSMQEALSGTPCLLGPGPVLTVLALLLASTLA corresponding to amino acids 419-630 of Q9BR17_HUMAN (SEQ ID NO:73), which also corresponds to amino acids 354-565 of HSU40434_P11 (SEQ ID NO:81), wherein said first amino acid sequence, second amino acid sequence and third amino acid sequence are contiguous and in a sequential order.

B. An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LG, having a structure as follows: a sequence starting from any of amino acid numbers 208-x to 208; and ending at any of amino acid numbers 209+((n−2)−x), in which x varies from 0 to n−2.

C. An isolated chimeric polypeptide encoding for an edge portion of HSU40434_P11 (SEQ ID NO:81), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 353-x to 353; and ending at any of amino acid numbers 354+((n−2)−x), in which x varies from 0 to n−2.

8. Comparison Report Between HSU40434_P11 (SEQ ID NO:81) and Q9UK57_HUMAN (SEQ ID NO:77):

A. An isolated chimeric polypeptide encoding for HSU40434_P11 (SEQ ID NO:81), comprising a first amino acid sequence being at least 70%, optionally at least 80%, preferably at least 85%, more preferably at least 90% and most preferably at least 95%, homologous to a polypeptide having the sequence MALPTARPLLGSCGTPALGSLL-FLLFSLGWVQPSRTLAGETGQEAA-PLDGVLANPPNISSL SPRQLLGFPCAEVSGLSTER-VRELAVALAQKNVKLSTEQLRCLAHRLSEPPEDLDAL PLDL LLFLNPDAFSGPQACTRFFSRITKAN-VDLLPRGAPERQRLLPAALACWGVRGSLLSEADV RALGGLACDLPGRFVAESAEVLLPRL-GIVAAWRQRSSRDPSWRQPERTILRPRFRRE (SEQ ID NO:531) corresponding to amino acids 1-239 of HSU40434_P11 (SEQ ID NO:81), a second amino acid sequence being at least 90% homologous to VEKTACPS-GKKAREIDESLIFYKKWELEACVDAAL-LATQMDRVNAIPFTYEQLDVLKHKL DELYPQGYPES-VIQHLGYLFLKMSPEDIRKWNVTSLETLKALLEVNK GHEMSPQVATLID RFVKGRGQLDKDTLDTL-TAFYPGYLCSLSPEELSSVPPSSIWAVR-PQDLDTCDPRQLDVLY PKARLAFQNMNGSEY-FVKIQSFLGGAPTEDLKALSQQNVSMDLATFMKLRT DAVLPLTV AEVQKLLGPHVEGLKAEERHRPVRD-WILRQRQDDLDTLGLGLQGGIPNGYLVLDLS corresponding to amino acids 1-296 of Q9UK57_HUMAN (SEQ ID NO:77), which also corresponds to amino acids 240-535 of HSU40434_P11 (SEQ ID NO:81), a first bridging amino acid M corresponding to amino acid 536 of HSU40434_P11 (SEQ ID NO:81), a second bridging amino acid Q corresponding to amino acid298 of Q9UK57_HUMAN (SEQ ID NO:77), which also corresponds to amino acid537 of HSU40434_P11 (SEQ ID NO:81), and a third amino acid sequence being at least 70%, optionally at least 80%, preferably at least 85%, more preferably at least 90% and most preferably at least 95% homologous to a polypeptide having the sequence EALSGTPCLLGPGPVLTVLALLLASTLA (SEQ ID NO:532) corresponding to amino acids 538-565 of HSU40434_P11 (SEQ ID NO:81), wherein said first amino acid sequence, second amino acid sequence, first bridging amino acid, second bridging amino acid and third amino acid sequence are contiguous and in a sequential order.

B. An isolated polypeptide encoding for a head of HSU40434_P11 (SEQ ID NO:81), comprising a polypeptide being at least 70%, optionally at least about 80%, preferably at least about 85%, more preferably at least about 90% and most preferably at least about 95% homologous to the sequence MALPTARPLLGSCGTPALGSLLFLLFS-LGWVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLLPRL-GIVAAWRQRSSRDPSWRQPERTILRPRFRRE (SEQ ID NO:531) of HSU40434_P11 (SEQ ID NO:81).

C. An isolated polypeptide encoding for an edge portion of HSU40434_P11 (SEQ ID NO:81), comprising an amino acid sequence being at least 70%, optionally at least about 80%, preferably at least about 85%, more preferably at least about 90% and most preferably at least about 95% homologous to the sequence EALSGTPCLLGPGPVLTVLALLLASTLA (SEQ ID NO:532) of HSU40434_P11 (SEQ ID NO:81).

The localization of the variant protein was determined according to results from a number of different software programs and analyses, including analyses from SignalP and other specialized programs. The variant protein is believed to be located as follows with regard to the cell: membrane.

Variant protein HSU40434_P11 (SEQ ID NO:81) also has the following non-silent SNPs (Single Nucleotide Polymorphisms) as listed in Table 51, (given according to their position(s) on the amino acid sequence, with the alternative amino acid(s) listed; the last column indicates whether the SNP is known or not; the presence of known SNPs in variant protein HSU40434_P11 (SEQ ID NO:81) sequence provides support for the deduced sequence of this variant protein according to the present invention).

TABLE 51

| SNP position(s) on amino acid sequence | Amino acid mutations Alternative amino acid(s) | Previously known SNP? |
|---|---|---|
| 51 | V -> | No |
| 118 | L -> V | No |
| 139 | R -> H | No |
| 162 | L -> Q | No |
| 268 | A -> | No |
| 268 | A -> P | No |
| 273 | A -> V | No |
| 285 | I -> N | No |
| 369 | D -> | No |
| 423 | A -> | No |
| 431 | N -> D | No |
| 536 | M -> V | No |

The glycosylation sites of variant protein HSU40434_P11 (SEQ ID NO:81), as compared to the known protein Mesothelin precursor (SEQ ID NO:71), are described in Table 52 (given according to their position(s) on the amino acid sequence in the first column; the second column indicates whether the glycosylation site is present in the variant protein; and the last column indicates whether the position is different on the variant protein).

TABLE 52

| Glycosylation site(s) | | |
|---|---|---|
| Position(s) on known amino acid sequence | Present in variant protein? | Position(s) on variant protein |
| 67 | Yes | 68 |
| 341 | Yes | 342 |
| 441 | Yes | 442 |
| 468 | Yes | 469 |

The variant protein has the following domains, as determined by using InterPro. The domains are described in Table 53:

TABLE 53

| InterPro domain(s) | | |
|---|---|---|
| Domain description | Analysis type | Position(s) on protein |
| Pre-pro-megakaryocyte potentiating factor precursor | HMMPfam | 1-565 |
| Hemopexin | ScanRegExp | 260-274 |

Variant protein HSU40434_P11(SEQ ID NO:81) is encoded by the following transcript(s): HSU40434_T12 (SEQ ID NO:30), for which the sequences) is/are given at the end of the application. The coding portion of transcript HSU40434_T12 (SEQ ID NO:30) is shown in bold; this coding portion starts at position 419 and ends at position 2113. The transcript also has the following SNPs as listed in Table 54 (given according to their position on the nucleotide sequence, with the alternative nucleic acid listed; the last column indicates whether the SNP is known or not; the presence of known SNPs in variant protein HSU40434_P11 (SEQ ID NO:81) sequence provides support for the deduced sequence of this variant protein according to the present invention).

TABLE 54

Nucleic acid SNPs

| SNP position(s) on nucleotide sequence | Alternative nucleic acid(s) | Previously known SNP? |
|---|---|---|
| 169 | G -> A | Yes |
| 333 | G -> A | Yes |
| 556 | G -> A | No |
| 571 | C -> | No |
| 770 | C -> G | No |
| 834 | G -> A | No |
| 903 | T -> A | No |
| 1220 | G -> C | No |
| 1220 | G -> | No |
| 1236 | C -> T | No |
| 1272 | T -> A | No |
| 1524 | A -> | No |
| 1685 | G -> | No |
| 1709 | A -> G | No |
| 2024 | A -> G | No |
| 2185 | G -> A | No |

Variant protein HSU40434_P14 (SEQ ID NO:82) according to the present invention has an amino acid sequence as given at the end of the application; it is encoded by transcript(s) HSU40434_T15 (SEQ ID NO:31). An alignment is given to the known protein (Mesothelin precursor (SEQ ID NO:71)) at the end of the application. One or more alignments to one or more previously published protein sequences are given at the end of the application. A brief description of the relationship of the variant protein according to the present invention to each such aligned protein is as follows:

1. Comparison Report Between HSU40434_P14 (SEQ ID NO:82) and NP_005814 (SEQ ID NO:78):

A. An isolated chimeric polypeptide encoding for HSU40434_P14 (SEQ ID NO:82), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACW corresponding to amino acids 1-170 of NP_005814 (SEQ ID NO:78), which also corresponds to amino acids 1-170 of HSU40434_P14 (SEQ ID NO:82), and a second amino acid sequence being at least 90% homologous to GIVAAWRQRSS-RDPSWRQPERTILRPRFRREVEKTACPS-GKKAREIDESLIFYKKWELEAC VDAALLATQM-DRVNAIPFTYEQLDVLKHKLDELYPQGYPESVIQHLG YLFLKMSPEDIRK WNVTSLETLKALLEVNKGHEM-SPQVATLIDRFVKGRGQLDKDTLDTL-TAFYPGYLCSLSP EELSSVPPSSIWAVRPQDLDTCD-PRQLDVLYPKARLAFQNMNGSEYFVKIQSFLGGAPT-ED LKALSQQNVSMDLATFMKLRTDAVLPLT-VAEVQKLLGPHVEGLKAEERHRPVRDWILRQ RQD-DLDTLGLGLQGGIPNGYLVLDLSM-QEALSGTPCLLGPGPVLTVLALLLASTLA corresponding to amino acids 266-622 of NP_005814 (SEQ ID NO:78), which also corresponds to amino acids 171-527 of HSU40434_P14 (SEQ ID NO:82), wherein said first amino acid sequence and second amino acid sequence are contiguous and in a sequential order.

B. An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)-x), in which x varies from 0 to n−2.

2. Comparison Report Between HSU40434_P14 (SEQ ID NO:82) and Q96KJ5_HUMAN (SEQ ID NO:79):

A. An isolated chimeric polypeptide encoding for HSU40434_P14 (SEQ ID NO:82), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACW corresponding to amino acids 1-170 of Q96KJ5_HUMAN (SEQ ID NO:79), which also corresponds to amino acids 1-170 of HSU40434_P14 (SEQ ID NO:82), and a second amino acid sequence being at least 90% homologous to GIVAAWRQRSSRDPSWRQPERTILR-PRFRREVEKTACPSGKKAREIDESLIFYKKWELEAC VDAALLATQMDRVNAIPFTYEQLDVLKH-KLDELYPQGYPESVIQHLGYLFLKMSPEDIRK WNVTSLETLKALLEVNKGHEMSPQ-VATLIDRFVKGRGQLDKDTLDTLTAFYPGYLCSLSP EELSSVPPSSIWAVRPQDLDTCDPRQLD-VLYPKARLAFQNMNGSEYFVKIQSFLGGAPTED LKALSQQNVSMDLATFMKLRTDAVLPLT-VAEVQKLLGPHVEGLKAEERHRPVRDWILRQ RQD-DLDTLGLGLQGGIPNGYLVLDLSM-QEALSGTPCLLGPGPVLTVLALLLASTLA corresponding to amino acids 266-622 of Q96KJ5_HUMAN (SEQ ID NO:79), which also corresponds to amino acids 171-527 of HSU40434_P14 (SEQ ID NO:82), wherein said first amino acid sequence and second amino acid sequence are contiguous and in a sequential order.

B. An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)-x), in which x varies from 0 to n−2.

3. Comparison Report Between HSU40434_P14 (SEQ ID NO:82) and Q96GR6_HUMAN (SEQ ID NO:72):

A. An isolated chimeric polypeptide encoding for HSU40434_P14 (SEQ ID NO:82), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-
LAQKNVKLSTEQLRCLAHRLSEPPEDLDALPLDL
LLFLNPDAFSGPQACTRFFSRITKAN-
VDLLPRGAPERQRLLPAALACW corresponding to amino acids 1-170 of Q96GR6_HUMAN (SEQ ID NO:72), which also corresponds to amino acids 1-170 of HSU40434_P14 (SEQ ID NO:82), a second amino acid sequence being at least 90% homologous to GIVAAWRQRSSRDPSWRQPERTILR-
PRFRREVEKTACPSGKKA corresponding to amino acids 266-308 of Q96GR6_HUMAN (SEQ ID NO:72), which also corresponds to amino acids 171-213 of HSU40434_P14 (SEQ ID NO:82), a bridging amino acid R corresponding to amino acid 214 of HSU40434_P14 (SEQ ID NO:82), and a third amino acid sequence being at least 90% homologous to EIDESLIFYKKWELEACVDAALLATQM-
DRVNAIPFTYEQLDVLKHKLDELYPQGYPESVI
QHLGYLFLKMSPEDIRKWNVTSLETLKA-
LLEVNKGHEMSPQVATLIDRFVKGRGQLDKD
TLDTLTAFYPGYLCSLSPEELSS-
VPPSSIWAVRPQDLDTCDPRQLDVLYP-
KARLAFQNMNG SEYFVKIQSFLGGAPTEDL-
KALSQQNVSMDLATFMKLRTDAVLPLTVAEVQKLLG
PHVE GLKAEERHRPVRDWILRQRQD-
DLDTLGLGLQGGIPNGYLVLDLSM-
QEALSGTPCLLGPGP VLTVLALLLASTLA corresponding to amino acids 310-622 of Q96GR6_HUMAN (SEQ ID NO:72), which also corresponds to amino acids 215-527 of HSU40434_P14 (SEQ ID NO:82), wherein said first amino acid sequence, second amino acid sequence, bridging amino acid and third amino acid sequence are contiguous and in a sequential order.

B. An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)−x), in which x varies from 0 to n−2.

4. Comparison Report Between HSU40434_P14 (SEQ ID NO:82) and Q14859_HUMAN (SEQ ID NO:74):

A. An isolated chimeric polypeptide encoding for HSU40434_P14 (SEQ ID NO:82), comprising a first amino acid sequence being at least 90% homologous to MALPTAR-
PLLGSCGTPALGSLLFLLFSLG-
WVQPSRTLAGETGQEAAPLDGVLANPPNISSL
SPRQLLGFPCAEVSGLSTERVRELAVA-
LAQKNVKLSTEQLRCLAHRLSEPPEDLDALPLDL
LLFLNPDAFSGPQACTRFFSRITKAN-
VDLLPRGAPERQRLLPAALACW corresponding to amino acids 1-170 of Q14859_HUMAN (SEQ ID NO:74), which also corresponds to amino acids 1-170 of HSU40434_P14 (SEQ ID NO:82), a second amino acid sequence being at least 90% homologous to GIVAAWRQRSSRDPSWRQPERTILR-
PRFRREVEKTACPSGKKAREIDESLIFYKKWELEAC
VDAALLATQMDRVNAIPFTYEQLDVLKH-
KLDELYPQGYPESVIQHLGYLFLKMSPEDIRK
WNVTSLETLKALLEVNKGHEMSPQ-
VATLIDRFVKGRGQLDKDTLDTLTAFYPGYLCSLSP
EELSSVPPSSIWAVRPQDLDTCDPRQLD-
VLYPKARLAFQNMNGSEYFVKIQSFLGGAPTED
LKALSQQNVSMDLATFMKLRTDAVLPLT-
VAEVQKLLGPHVEGLKAEERHRPVRDWILRQ RQD-
DLDTLGLGLQGGIPNGYLVLDLS corresponding to amino acids 266-592 of Q14859_HUMAN (SEQ ID NO:74), which also corresponds to amino acids 171-497 of HSU40434_P14 (SEQ ID NO:82), a bridging amino acid M corresponding to amino acid 498 of HSU40434_P14 (SEQ ID NO:82), and a third amino acid sequence being at least 90% homologous to QEALSGTPCLLGPGPVLTVLA-
LLLASTLA corresponding to amino acids 594-622 of Q14859_HUMAN (SEQ ID NO:74), which also corresponds to amino acids 499-527 of HSU40434_P14 (SEQ ID NO:82), wherein said first amino acid sequence, second amino acid sequence, bridging amino acid and third amino acid sequence are contiguous and in a sequential order.

B. An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)−x), in which x varies from 0 to n−2.

5. Comparison Report Between HSU40434_P14 (SEQ ID NO:82) and Q9BTR2_HUMAN (SEQ ID NO:75):

A. An isolated chimeric polypeptide encoding for HSU40434_P14 (SEQ ID NO:82), comprising a first amino acid sequence being at least 90% homologous to MALPTAR-
PLLGSCGTPALGSLLFLLFSLGWVQPSRTLAGETGQ
corresponding to amino acids 1-43 of Q9BTR2_HUMAN (SEQ ID NO:75), which also corresponds to amino acids 1-43 of HSU40434_P14 (SEQ ID NO:82), a first bridging amino acid E corresponding to amino acid 44 of HSU40434_P14 (SEQ ID NO:82), a second amino acid sequence being at least 90% homologous to AAPLDGVLANPPNISSLSPRQLLG-
FPCAEVSGLSTERVRELAVALAQKNVKLSTEQLRCLA
HRLSEPPEDLDALPLDLLLFLNPDAFSG-
PQACTRFFSRITKANVDLLPRGAPERQRLLPAAL
ACW corresponding to amino acids 44-169 of Q9BTR2_HUMAN (SEQ ID NO:75), which also corresponds to amino acids 45-170 of HSU40434_P14 (SEQ ID NO:82), a third amino acid sequence being at least 90% homologous to GIVAAWRQRSSRDPSWRQPERTILR-
PRFRREVEKTACPSGKKAREIDESLIFYKKWELEAC
VDAALLATQMDRVNAIPFTYEQLDVLKH-
KLDELYPQGYPESVIQHLGYLFLKMSPEDIRK
WNVTSLETLKALLEVNKGHEMSPQ-
VATLIDRFVKGRGQLDKDTLDTLTAFYPGYLCSLSP
EELSSVPPSSIWAVRPQDLDTCDPRQLD-
VLYPKARLAFQNMNGSEYFVKIQSFLGGAPTED
LKALSQQNVSMDLATFMKLRTDAVLPLT-
VAEVQKLLGPHVEGLKAEERHRPVRDWILRQ RQD-
DLDTLGLGLQGGIPNGYLVLDLS corresponding to amino acids 265-591 of Q9BTR2_HUMAN (SEQ ID NO:75), which also corresponds to amino acids 171-497 of HSU40434_P14 (SEQ ID NO:82), a second bridging amino acid M corresponding to amino acid 498 of HSU40434_P14 (SEQ ID NO:82), and a fourth amino acid sequence being at least 90% homologous to QEALSGTPCLLGPGPVLTVLA-
LLLASTLA corresponding to amino acids 593-621 of Q9BTR2_HUMAN (SEQ ID NO:75), which also corresponds to amino acids 499-527 of HSU40434_P14 (SEQ ID NO:82), wherein said first amino acid sequence, first bridging amino acid, second amino acid sequence, third amino acid sequence, second bridging amino acid and fourth amino acid sequence are contiguous and in a sequential order.

B. An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)−x), in which x varies from 0 to n−2.

6. Comparison Report Between HSU40434_P14 (SEQ ID NO:82) and NP_037536 (SEQ ID NO:76):

A. An isolated chimeric polypeptide encoding for HSU40434_P14 (SEQ ID NO:82), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACW corresponding to amino acids 1-170 of NP_037536 (SEQ ID NO:76), which also corresponds to amino acids 1-170 of HSU40434_P14 (SEQ ID NO:82), a second amino acid sequence being at least 90% homologous to GIVAAWRQRSSRDPSWRQPERTIL-RPRFRREVEKTACPSGKKAREIDESLIFYKKWELEAC VDAALLATQMDRVNAIPFTYEQLDVLKH-KLDELYPQGYPESVIQHLGYLFLKMSPEDIRK WNVTSLETLKALLEVNKGHEMSPQ corresponding to amino acids 266-410 of NP_037536 (SEQ ID NO:76), which also corresponds to amino acids 171-315 of HSU40434_P14 (SEQ ID NO:82), and a third amino acid sequence being at least 90% homologous to VATLIDRFVKGRGQLD-KDTLDTLTAFYPGYLCSLSPEELSS-VPPSSIWAVRPQDLDTCDPR QLDVLYPKARLAFQNM-NGSEYFVKIQSFLGGAPTEDLKALSQQNVSMDLATF MKLRTDA VLPLTVAEVQKLLGPHVEGLKAEERHR-PVRDWILRQRQDDLDTLGLGLQGGIPNGYLVL DLSMQEALSGTPCLLGPGPVLTVLALLLASTLA corresponding to amino acids 419-630 of NP_037536 (SEQ ID NO:76), which also corresponds to amino acids 316-527 of HSU40434_P14 (SEQ ID NO:82), wherein said first amino acid sequence, second amino acid sequence and third amino acid sequence are contiguous and in a sequential order.

B. An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)−x), in which x varies from 0 to n−2.

C. An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 315-x to 315; and ending at any of amino acid numbers 316+((n−2)−x), in which x varies from 0 to n−2.

7. Comparison Report Between HSU40434_P14 (SEQ ID NO:82) and Q9BR17_HUMAN (SEQ ID NO:73):

A. An isolated chimeric polypeptide encoding for HSU40434_P14 (SEQ ID NO:82), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACW corresponding to amino acids 1-170 of Q9BR17_HUMAN (SEQ ID NO:73), which also corresponds to amino acids 1-170 of HSU40434_P14 (SEQ ID NO:82), a second amino acid sequence being at least 90% homologous to GIVAAWRQRSSRDPSWRQPERTILR-PRFRREVEKTACPSGKKAREIDESLIFYKKWELEAC VDAALLATQMDRVNAIPFTYEQLDVLKH-KLDELYPQGYPESVIQHLGYLFLKMSPEDIRK WNVTSLETLKALLEVNKGHEMSPQ corresponding to amino acids 266-410 of Q9BR17_HUMAN (SEQ ID NO:73), which also corresponds to amino acids 171-315 of HSU40434_P14 (SEQ ID NO:82), and a third amino acid sequence being at least 90% homologous to VATLIDRFVKGRGQLDKDTLDTL-TAFYPGYLCSLSPEELSSVPPSSIWAVRPQDLDTCDPR QLDVLYPKARLAFQNMNGSEYFVKIQS-FLGGAPTEDLKALSQQNVSMDLATFMKLRTDA VLPLTVAEVQKLLGPHVEGLKAEERHR-PVRDWILRQRQDDLDTLGLGLQGGIPNGYLVL DLSMQEALSGTPCLLGPGPVLTVLALLLASTLA corresponding to amino acids 419-630 of Q9BR17_HUMAN (SEQ ID NO:73), which also corresponds to amino acids 316-527 of HSU40434_P14 (SEQ ID NO:82), wherein said first amino acid sequence, second amino acid sequence and third amino acid sequence are contiguous and in a sequential order.

B. An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise WG, having a structure as follows: a sequence starting from any of amino acid numbers 170-x to 170; and ending at any of amino acid numbers 171+((n−2)−x), in which x varies from 0 to n−2.

C. An isolated chimeric polypeptide encoding for an edge portion of HSU40434_P14 (SEQ ID NO:82), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 315-x to 315; and ending at any of amino acid numbers 316+((n−2)−x), in which x varies from 0 to n−2.

8. Comparison Report Between HSU40434_P14 (SEQ ID NO:82) and Q9UK57_HUMAN (SEQ ID NO:77):

A. An isolated chimeric polypeptide encoding for HSU40434_P14 (SEQ ID NO:82), comprising a first amino acid sequence being at least 70%, optionally at least 80%, preferably at least 85%, more preferably at least 90% and most preferably at least 95%, homologous to a polypeptide having the sequence MALPTARPLLGSCGTPALGSLL-FLLFSLGWVQPSRTLAGETGQEAA-PLDGVLANPPNISSL SPRQLLGFPCAEVSGLSTER-VRELAVALAQKNVKLSTEQLRCLAHRLSEPPEDLDAL PLDL LLFLNPDAFSGPQACTRFFSRITKAN-VDLLPRGAPERQRLLPAALACWGIVAAWRQRSSR DPSWRQPERTILRPRFRRE (SEQ ID NO:536) corresponding to amino acids 1-201 of HSU40434_P14 (SEQ ID NO:82), a second amino acid sequence being at least 90% homologous to VEKTACPSGKKAREIDESLIFYKKWE-LEACVDAALLATQMDRVNAIPFTYEQLDVLKHKL DELYPQGYPESVIQHLGYLFLKMS-PEDIRKWNVTSLETLKALLEVNKGHEMSPQVATLID RFVKGRGQLDKDTLDTLTAFYPGYLCSL-SPEELSSVPPSSIWAVRPQDLDTCDPRQLDVLY PKAR-LAFQNMNGSEYFVKIQSFLGGAPTEDL-KALSQQNVSMDLATFMKLRTDAVLPLTV AEVQKLLGPHVEGLKAEERHRPVRDWIL-RQRQDDLDTLGLGLQGGIPNGYLVLDLS corresponding to amino acids 1-296 of Q9UK57_HUMAN (SEQ ID NO:77), which also corresponds to amino acids 202-497 of HSU40434_P14 (SEQ ID NO:82), a first bridging amino acid M corresponding to amino acid 498 of HSU40434_P14 (SEQ ID NO:82), a second bridging amino acid Q corresponding to amino acid 298 of Q9UK57_HUMAN (SEQ ID NO:77), which also corresponds to amino acid 499 of HSU40434_P14 (SEQ ID NO:82), and a third amino acid sequence being at least 70%, optionally at least 80%, preferably at least 85%, more preferably at least 90% and most preferably at least 95% homologous to a polypeptide having the sequence EALSGT-PCLLGPGPVLTVLALLLASTLA (SEQ ID NO:532) corresponding to amino acids 500-527 of HSU40434_P14 (SEQ ID NO:82), wherein said first amino acid sequence, second amino acid sequence, first bridging amino acid, second bridging amino acid and third amino acid sequence are contiguous and in a sequential order.

B. An isolated polypeptide encoding for a head of HSU40434_P14 (SEQ ID NO:82), comprising a polypeptide being at least 70%, optionally at least about 80%, preferably at least about 85%, more preferably at least about 90% and most preferably at least about 95% homologous to the sequence MALPTARPLLGSCGTPALGSLLFLLFS-LGWVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGIVAAWRQRSSR DPSWRQPERTILRPRFRRE (SEQ ID NO:536) of HSU40434_P14 (SEQ ID NO:82).

C. An isolated polypeptide encoding for an edge portion of HSU40434_P14 (SEQ ID NO:82), comprising an amino acid sequence being at least 70%, optionally at least about 80%, preferably at least about 85%, more preferably at least about 90% and most preferably at least about 95% homologous to the sequence EALSGTPCLLGPGPVLTVLALLLASTLA (SEQ ID NO:532) of HSU40434_P14 (SEQ ID NO:82).

The localization of the variant protein was determined according to results from a number of different software programs and analyses, including analyses from SignalP and other specialized programs. The variant protein is believed to be located as follows with regard to the cell: membrane.

Variant protein HSU40434_P14 (SEQ ID NO:82) also has the following non-silent SNPs (Single Nucleotide Polymorphisms) as listed in Table 55, (given according to their position(s) on the amino acid sequence, with the alternative amino acid(s) listed; the last column indicates whether the SNP is known or not; the presence of known SNPs in variant protein HSU40434_P14 (SEG ID NO:82) sequence provides support for the deduced sequence of this variant protein according to the present invention).

TABLE 55

| Amino acid mutations | | |
| --- | --- | --- |
| SNP position(s) on amino acid sequence | Alternative amino acid(s) | Previously known SNP? |
| 51 | V -> | No |
| 118 | L -> V | No |
| 139 | R -> H | No |
| 162 | L -> Q | No |
| 230 | A -> | No |
| 230 | A -> P | No |
| 235 | A -> V | No |
| 247 | I -> N | No |
| 331 | D -> | No |
| 385 | A -> | No |
| 393 | N -> D | No |
| 498 | M -> V | No |

The glycosylation sites of variant protein HSU40434_P14 (SEQ ID NO:82), as compared to the known protein Mesothelin precursor (SEQ ID NO:71), are described in Table 56 (given according to their position(s) on the amino acid sequence in the first column; the second column indicates whether the glycosylation site is present in the variant protein; and the last column indicates whether the position is different on the variant protein).

TABLE 56

| Glycosylation site(s) | | |
| --- | --- | --- |
| Position(s) on known amino acid sequence | Present in variant protein? | Position(s) on variant protein |
| 67 | Yes | 68 |
| 303 | Yes | 304 |
| 403 | Yes | 404 |
| 430 | Yes | 431 |

The variant protein has the following domains, as determined by using InterPro. The domains are described in Table 57:

TABLE 57

| InterPro domain(s) | | |
| --- | --- | --- |
| Domain description | Analysis type | Position(s) on protein |
| Pre-pro-megakaryocyte potentiating factor precursor | HMMPfam | 1-527 |
| Hemopexin | ScanRegExp | 222-236 |

Variant protein HSU40434_P14 (SEQ ID NO:82) is encoded by the following transcript(s): HSU40434_T15 (SEQ ID NO:31), for which the sequence(s) is/are given at the end of the application. The coding portion of transcript HSU40434_T15 (SEQ ID NO:31) is shown in bold; this coding portion starts at position 419 and ends at position 1999. The transcript also has the following SNPs as listed in Table 58 (given according to their position on the nucleotide sequence, with the alternative nucleic acid listed; the last column indicates whether the SNP is known or not; the presence of known SNPs in variant protein HSU40434_P14 (SEQ ID NO:82) sequence provides support for the deduced sequence of this variant protein according to the present invention).

TABLE 58

Nucleic acid SNPs

| SNP position(s) on nucleotide sequence | Alternative nucleic acid(s) | Previously known SNP? |
|---|---|---|
| 169 | G -> A | Yes |
| 333 | G -> A | Yes |
| 556 | G -> A | No |
| 571 | C -> | No |
| 770 | C -> G | No |
| 834 | G -> A | No |
| 903 | T -> A | No |
| 1106 | G -> C | No |
| 1106 | G -> | No |
| 1122 | C -> T | No |
| 1158 | T -> A | No |
| 1410 | A -> | No |
| 1571 | G -> | No |
| 1595 | A -> G | No |
| 1910 | A -> G | No |
| 2071 | G -> A | No |

Variant protein HSU40434_P16 (SEQ ID NO:83) according to the present invention has an amino sequence as given at the end of the application; it is encoded by transcript(s) HSU40434_T17 (SEQ ID NO:32). An alignment is given to the known protein (Mesothelin precursor (SEQ ID NO:71)) at the end of the application. One or more alignments to one or more previously published protein sequences are given at the end of the application. A brief description of the relationship of the variant protein according to the present invention to each such aligned protein is as follows:

1. Comparison Report Between HSU40434_P16 (SEQ ID NO:83) and NP_005814 (SEQ ID NO:78)):

A. An isolated chimeric polypeptide encoding for HSU40434_P16 (SEQ ID NO:83), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLL-PRLVSCPGPLDQDQQEAARAALQGGGPPYGPPSTWS VSTMDALRGLLPVLGQPIIRSIPQ-GIVAAWRQRSSRDPSWRQPERTILR-PRFRREVEKTACP SGKKAREIDESLIFYKKWE-LEACVDAALLATQMDRVNAIPFTYEQLDVLKHKLDE LYPQG YPESVIQHLGYLFLKMSPEDIRKWNVTS-LETLKALLEVNKGHEMSPQ corresponding to amino acids 1-410 of NP_005814 (SEQ ID NO:78), which also corresponds to amino acids 1-410 of HSU40434_P16 (SEQ ID NO:83), and a second amino acid sequence being at least 90% homologous to NMNGSEYFVKIQSFLGGAPTEDL-KALSQQNVSMDLATFMKLRTDAVLPLTVAEVQKLLG PHVEGLKAEERHRPVRDWILRQRQD-DLDTLGLGLQGGIPNGYLVLDLSMQEALSGTPCLL GPGPVLTVLALLLASTLA corresponding to amino acids 486-622 of NP_005814 (SEQ ID NO:78), which also corresponds to amino acids 411-547 of HSU40434_P16 (SEQ ID NO:83), wherein said first amino acid sequence and second amino acid sequence are contiguous and in a sequential order.

B. An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

2. Comparison Report Between HSU40434_P16 (SEQ ID NO:83) and Q96KJ5_HUMAN (SEQ ID NO:79):

A. An isolated chimeric polypeptide encoding for HSU40434_P16 (SEQ ID NO:83), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLL-PRLVSCPGPLDQDQQEAARAALQGGGPPYGPPSTWS VSTMDALRGLLPVLGQPIIRSIPQ-GIVAAWRQRSSRDPSWRQPERTILR-PRFRREVEKTACP SGKKAREIDESLIFYKKWE-LEACVDAALLATQMDRVNAIPFTYEQLDVLKHKLDE LYPQG YPESVIQHLGYLFLKMSPEDIRKWNVTS-LETLKALLEVNKGHEMSPQ corresponding to amino acids 1-410 of Q96KJ5_HUMAN (SEQ ID NO:79), which also corresponds to amino acids 1-410 of HSU40434_P16 (SEQ ID NO:83), and a second amino acid sequence being at least 90% homologous to NMNGSEYFVKIQSFLGGAPT-EDLKALSQQNVSMDLATFMKLRTDAVL-PLTVAEVQKLLG PHVEGLKAEERHRPVRDWIL-RQRQDDLDTLGLGLQGGIPNGYLVLDLSMQEALSGT PCLL GPGPVLTVLALLLASTLA corresponding to amino acids 486-622 of Q96KJ5_HUMAN (SEQ ID NO:79), which also corresponds to amino acids 411-547 of HSU40434_P16 (SEQ ID NO:83), wherein said first amino acid sequence and second amino acid sequence are contiguous and in a sequential order.

B. An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

3. Comparison Report Between HSU40434_P16 (SEQ ID NO:83) and Q96GR6_HUMAN (SEQ ID NO:72):

A. An isolated chimeric polypeptide encoding for HSU40434_P16 (SEQ ID NO:83), comprising a first amino acid sequence being at least 90% homologous to MALPTAR-PLLGSCGTPALGSLLFLLFSLG-WVQPSRTLAGETGQEAAPLDGVLANPPNISSL SPRQLLGFPCAEVSGLSTERVRELAVA- LAQKNVKLSTEQLRCLAHRLSEPPEDLDALPLDL LLFLNPDAFSGPQACTRFFSRITKAN- VDLLPRGAPERQRLLPAALACWGVRGSLLSEADV RALGGLACDLPGRFVAESAEVLL- PRLVSCPGPLDQDQQEAARAALQGGGPPYGPPSTWS VSTMDALRGLLPVLGQPIIRSIPQ- GIVAAWRQRSSRDPSWRQPERTILR- PRFRREVEKTACP SGKKA corresponding to amino acids 1-308 of Q96GR6_HUMAN (SEQ ID NO:72), which also corresponds to amino acids 1-308 of HSU40434_P16 (SEQ ID NO:83), a bridging amino acid R corresponding to amino acid 309 of HSU40434_P16 (SEQ ID NO:83), a second amino acid sequence being at least 90% homologous to EIDESLIFYKKWELEACVDAALLATQM- DRVNAIPFTYEQLDVLKHKLDELYPQGYPESVI QHLGYLFLKMSPEDIRKWNVTSLETLKA- LLEVNKGHEMSPQ corresponding to amino acids 310-410 of Q96GR6_HUMAN (SEQ ID NO:72), which also corresponds to amino acids 310-410 of HSU40434_P16 (SEQ ID NO:83), and a third amino acid sequence being at least 90% homologous to NMNGSEYFVKIQSFLGGAPTEDL- KALSQQNVSMDLATFMKLRTDAVLPLTVAEVQKLLG PHVEGLKAEERHRPVRDWILRQRQD- DLDTLGLGLQGGIPNGYLVLDLSMQEALSGTPCLL GPGPVLTVLALLLASTLA corresponding to amino acids 486-622 of Q96GR6_HUMAN (SEQ ID NO:72), which also corresponds to amino acids 411-547 of HSU40434_P16 (SEQ ID NO:83), wherein said first amino acid sequence, bridging amino acid, second amino acid sequence and third amino acid sequence are contiguous and in a sequential order.

B. An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

4. Comparison Report Between HSU40434_P16 (SEQ ID NO:83) and Q14859_HUMAN (SEQ ID NO:74):

A. An isolated chimeric polypeptide encoding for HSU40434_P16 (SEQ ID NO:83), comprising a first amino acid sequence being at least 90% homologous to MALPTAR- PLLGSCGTPALGSLLFLLFSLG- WVQPSRTLAGETGQEAAPLDGVLANPPNISSL SPRQLLGFPCAEVSGLSTERVRELAVA- LAQKNVKLSTEQLRCLAHRLSEPPEDLDALPLDL LLFLNPDAFSGPQACTRFFSRITKAN- VDLLPRGAPERQRLLPAALACWGVRGSLLSEADV RALGGLACDLPGRFVAESAEVLL- PRLVSCPGPLDQDQQEAARAALQGGGPPYGPPSTWS VSTMDALRGLLPVLGQPIIRSIPQ- GIVAAWRQRSSRDPSWRQPERTILR- PRFRREVEKTACP SGKKAREIDESLIFYKKWE- LEACVDAALLATQMDRVNAIPFTYEQLDVLKHKLDE LYPQG YPESVIQHLGYLFLKMSPEDIRKWNVTS- LETLKALLEVNKGHEMSPQ corresponding to amino acids 1-410 of Q14859_HUMAN (SEQ ID NO:74), which also corresponds to amino acids 1-410 of HSU40434_P16 (SEQ ID NO:83), a second amino acid sequence being at least 90% homologous to NMNGSEYFVKIQSFLGGAPTEDL- KALSQQNVSMDLATFMKLRTDAVLPLTVAEVQKLLG PHVEGLKAEERHRPVRDWILRQRQD- DLDTLGLGLQGGIPNGYLVLDLS corresponding to amino acids 486-592 of Q14859_HUMAN (SEQ ID NO:74), which also corresponds to amino acids 411-517 of HSU40434_P16 (SEQ ID NO:83), a bridging amino acid M corresponding to amino acid 518 of HSU40434_P16 (SEQ ID NO:83), and a third amino acid sequence being at least 90% homologous to QEALSGTPCLLGPGPVLTVLA- LLLASTLA corresponding to amino acids 594-622 of Q14859_HUMAN (SEQ ID NO:74), which also corresponds to amino acids 519-547 of HSU40434_P16 (SEQ ID NO:83), wherein said first amino acid sequence, second amino acid sequence, bridging amino acid and third amino acid sequence are contiguous and in a sequential order.

B. An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

5. Comparison Report Between HSU40434_P16 (SEQ ID NO:83) and Q9BTR2_HUMAN (SEQ ID NO:75):

A. An isolated chimeric polypeptide encoding for HSU40434_P16 (SEQ ID NO:83), comprising a first amino acid sequence being at least 90% homologous to MALPTAR- PLLGSCGTPALGSLLFLLFSLGWVQPSRTLAGETGQ corresponding to amino acids 1-43 of Q9BTR2_HUMAN (SEQ ID NO:75), which also corresponds to amino acids 1-43 of HSU40434_P16 (SEQ ID NO:83), a first bridging amino acid E corresponding to amino acid 44 of HSU40434_P16 (SEQ ID NO:83), a second amino acid sequence being at least 90% homologous to AAPLDGVLANPPNISSLSPRQLLG- FPCAEVSGLSTERVRELAVALAQKNVKLSTEQLRCLA HRLSEPPEDLDALPLDLLLFLNPDAFSG- PQACTRFFSRITKANVDLLPRGAPERQRLLPAAL ACWGVRGSLLSEADVRALGGLACDLPGR- FVAESAEVLLPRLVSCPGPLDQDQQEAARAA LQGGGPPYGPPSTWSVSTMDALRGLLPV- LGQPIIRSIPQGIVAAWRQRSSRDPSWRQPERTI LRPRFRREVEKTACPSGKKAREIDESLI- FYKKWELEACVDAALLATQMDRVNAIPFTYEQ LDV- LKHKLDELYPQGYPESVIQHLGYLFLKM- SPEDIRKWNVTSLETLKALLEVNKGHEMS PQ corresponding to amino acids 44-409 of Q9BTR2_HUMAN (SEQ ID NO:75), which also corresponds to amino acids 45-410 of HSU40434_P16 (SEQ ID NO:83), a third amino acid sequence being at least 90% homologous to NMNG- SEYFVKIQSFLGGAPTEDLKALSQQN- VSMDLATFMKLRTDAVLPLTVAEVQKLLG PHVEGL- KAEERHRPVRDWILRQRQDDLDTLGLGLQGGIPNGY LVLDLS corresponding to amino acids 485-591 of Q9BTR2_HUMAN (SEQ ID NO:75), which also corresponds to amino acids 411-517 of HSU40434_P16 (SEQ ID NO:83), a second bridging amino acid M corresponding to amino acid 518 of HSU40434_P16 (SEQ ID NO:83), and a fourth amino acid sequence being at least 90% homologous to QEALSGTPCLLGPGPVLTVLALLLASTLA correspond- ing to amino acids 593-621 of Q9BTR2_HUMAN (SEQ ID NO:75), which also corresponds to amino acids 519-547 of HSU40434_P16 (SEQ ID NO:83), wherein said first amino acid sequence, first bridging amino acid, second amino acid sequence, third amino acid sequence, second bridging amino acid and fourth amino acid sequence.

B. An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

6. Comparison Report Between HSU40434_P16 (SEQ ID NO:83) and NP_037536 (SEQ ID NO:76):

A. An isolated chimeric polypeptide encoding for HSU40434_P16 (SEQ ID NO:83), comprising a first amino acid sequence being at least 90% homologous to MALPTARPLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLL-PRLVSCPGPLDQDQQEAARAALQGGGPPYGPPSTWS VSTMDALRGLLPVLGQPIIRSIPQ-GIVAAWRQRSSRDPSWRQPERTILR-PRFRREVEKTACP GKKAREIDESLIFYKKWE-LEACVDAALLATQMDRVNAIPFTYEQLDVLKHKLDE LYPQG YPESVIQHLGYLFLKMSPEDIRKWNVTS-LETLKALLEVNKGHEMSPQ corresponding to amino acids 1-410 of NP_037536 (SEQ ID NO:76), which also corresponds to amino acids 1-410 of HSU40434_P16 (SEQ ID NO:83), and a second amino acid sequence being at least 90% homologous to NMNGSEYFVKIQSFLGGAPTEDL-KALSQQNVSMDLATFMKLRTDAVLPLTVAEVQKLLG PHVEGLKAEERHRPVRDWILRQRQD-DLDTLGLGLQGGIPNGYLVLDLSMQEALSGTPCLL GPGPVLTVLALLLASTLA corresponding to amino acids 494-630 of NP_037536 (SEQ ID NO:76), which also corresponds to amino acids 411-547 of HSU40434_P16 (SEQ ID NO:83), wherein said first amino acid sequence and second amino acid sequence are contiguous and in a sequential order.

B. An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

7. Comparison Report Between HSU40434_P16 (SEQ ID NO:83) and Q9BR17_HUMAN (SEQ ID NO:73):

A. An isolated chimeric polypeptide encoding for HSU40434_P16 (SEQ ID NO:83), comprising a first amino acid sequence being at least 90% homologous to MALPTARPLLGSCGTPALGSLLFLLFSLG-WVQPSRTLAGETGQEAAPLDGVLANPPNISSL SPRQLLGFPCAEVSGLSTERVRELAVA-LAQKNVKLSTEQLRCLAHRLSEPPEDLDALPLDL LLFLNPDAFSGPQACTRFFSRITKAN-VDLLPRGAPERQRLLPAALACWGVRGSLLSEADV RALGGLACDLPGRFVAESAEVLL-PRLVSCPGPLDQDQQEAARAALQGGGPPYGPPSTWS VSTMDALRGLLPVLGQPIIRSIPQ-GIVAAWRQRSSRDPSWRQPERTILR-PRFRREVEKTACP SGKKAREIDESLIFYKKWE-LEACVDAALLATQMDRVNAIPFTYEQLDVLKHKLDE LYPQG YPESVIQHLGYLFLKMSPEDIRKWNVTS-LETLKALLEVNKGHEMSPQ corresponding to amino acids 1-410 of Q9BR17_HUMAN (SEQ ID NO:73), which also corresponds to amino acids 1-410 of HSU40434_P16 (SEQ ID NO:83), and a second amino acid sequence being at least 90% homologous to NMNGSEYFVKIQSFLGGAPT-EDLKALSQQNVSMDLATFMKLRTDAVL-PLTVAEVQKLLG PHVEGLKAEERHRPVRDWIL-RQRQDDLDTLGLGLQGGIPNGYLVLDLSMQEALSGT PCLL GPGPVLTVLALLLASTLA corresponding to amino acids 494-630 of Q9BR17_HUMAN (SEQ ID NO:73), which also corresponds to amino acids 411-547 of HSU40434_P16 (SEQ ID NO:83), wherein said first amino acid sequence and second amino acid sequence are contiguous and in a sequential order.

B. An isolated chimeric polypeptide encoding for an edge portion of HSU40434_P16 (SEQ ID NO:83), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QN, having a structure as follows: a sequence starting from any of amino acid numbers 410-x to 410; and ending at any of amino acid numbers 411+((n−2)−x), in which x varies from 0 to n−2.

The localization of the variant protein was determined according to results from a number of different software programs and analyses, including analyses from SignalP and other specialized programs. The variant protein is believed to be located as follows with regard to the cell: membrane.

Variant protein HSU40434_P16 (SEQ ID NO:83) also has the following non-silent SNPs (Single Nucleotide Polymorphisms) as listed in Table 59, (given according to their position(s) on the amino acid sequence, with the alternative amino acid(s) listed; the last column indicates whether the SNP is known or not; the presence of known SNPs in variant protein HSU40434_P16 (SEQ ID NO:83) sequence provides support for the deduced sequence of this variant protein according to the present invention).

TABLE 59

| | Amino acid mutations | |
|---|---|---|
| SNP position(s) on amino acid sequence | Alternative amino acid(s) | Previously known SNP? |
| 51 | V -> | No |
| 118 | L -> V | No |
| 139 | R -> H | No |
| 162 | L -> Q | No |
| 225 | A -> P | No |
| 225 | A -> S | No |
| 232 | P -> | No |
| 325 | A -> | No |
| 325 | A -> P | No |
| 330 | A -> V | No |
| 342 | I -> N | No |
| 413 | N -> D | No |
| 518 | M -> V | No |

The glycosylation sites of variant protein HSU40434_P16 (SEQ ID NO:83), as compared to the known protein Mesothelin precursor (SEQ ID NO:71), are described in Table 60 (given according to their position(s) on the amino acid sequence in the first column; the second column indicates whether the glycosylation site is present in the variant protein; and the last column indicates whether the position is different on the variant protein).

TABLE 60

Glycosylation site(s)

| Position(s) on known amino acid sequence | Present in variant protein? | Position(s) on variant protein |
|---|---|---|
| 67 | Yes | 68 |
| 398 | Yes | 399 |
| 423 | Yes | 424 |
| 450 | Yes | 451 |

The variant protein has the following domains, as determined by using InterPro. The domains are described in Table 61:

TABLE 61

InterPro domain(s)

| Domain description | Analysis type | Position(s) on protein |
|---|---|---|
| Pre-pro-megakaryocyte potentiating factor precursor | HMMPfam | 1-547 |
| Hemopexin | ScanRegExp | 317-331 |

Variant protein HSU40434_P16 (SEQ ID NO:83) is encoded by the following transcript(s): HSU40434_T17 (SEQ ID NO:32), for which the sequence(s) is/are given at the end of the application. The coding portion of transcript HSU40434_T17 (SEQ ID NO:32) is shown in bold; this coding portion starts at position 419 and ends at position 2059. The transcript also has the following SNPs as listed in Table 62 (given according to their position on the nucleotide sequence, with the alternative nucleic acid listed; the last column indicates whether the SNP is known or not; the presence of known SNPs in variant protein HSU40434_P16 (SEQ ID NO:83) sequence provides support for the deduced sequence of this variant protein according to the present invention).

TABLE 62

Nucleic acid SNPs

| SNP position(s) on nucleotide sequence | Alternative nucleic acid(s) | Previously known SNP? |
|---|---|---|
| 169 | G -> A | Yes |
| 333 | G -> A | Yes |
| 556 | G -> A | No |
| 571 | C -> | No |
| 770 | C -> G | No |
| 834 | G -> A | No |
| 903 | T -> A | No |
| 1091 | G -> C | No |
| 1091 | G -> T | No |
| 1112 | C -> | No |
| 1391 | G -> C | No |
| 1391 | G -> | No |
| 1407 | C -> T | No |
| 1443 | T -> A | No |
| 1655 | A -> G | No |
| 1970 | A -> G | No |
| 2131 | G -> A | No |

Variant protein HSU40434_P18 (SEQ ID NO:84) according to the present invention has an amino acid sequence as given at the end of the application; it is encoded by transcript(s) HSU40434_T19 (SEQ ID NO:33). An alignment is given to the known protein (Mesothelin precursor (SEQ ID NO:71)) at the end of the application. One or more alignments to one or more previously published protein sequences are given at the end of the application. A brief description of the relationship of the variant protein according to the present invention to each such aligned protein is as follows:

1. Comparison Report Between HSU40434_P18 (SEQ ID NO:84) and NP_005814 (SEQ ID NO:78):
   A. An isolated chimeric polypeptide encoding for HSU40434_P18 (SEQ ID NO:84), comprising a first amino acid sequence being at least 90% homologous to MALPTARPLLGSCGTPALGSLLFLLFSLG-WVQPSRTLAGETGQEAAPLDGVLANPPNISSL SPRQLLGFPCAEVSGLSTERVRELAVA-LAQKNVKLSTEQ corresponding to amino acids 1-100 of NP_005814 (SEQ ID NO:78), which also corresponds to amino acids 1-100 of HSU40434_P18 (SEQ ID NO:84), and a second amino acid sequence being at least 90% homologous to GIVAAWRQRSSRDPSWRQPERTILR-PRFRREVEKTACPSGKKAREIDESLIFYKKWELEAC VDAALLATQMDRVNAIPFTYEQLDVLKH-KLDELYPQGYPESVIQHLGYLFLKMSPEDIRK WNVTSLETLKALLEVNKGHEMSPQ-VATLIDRFVKGRGQLDKDTLDTLTAFYPGYLCSLSP EELSSVPPSSIWAVRPQDLDTCDPRQLD-VLYPKARLAFQNMNGSEYFVKIQSFLGGAPTED LKALSQQNVSMDLATFMKLRTDAVLPLT-VAEVQKLLGPHVEGLKAEERHRPVRDWILRQ RQD-DLDTLGLGLQGGIPNGYLVLDLSM-QEALSGTPCLLGPGPVLTVLALLLASTLA corresponding to amino acids 266-622 of NP_005814 (SEQ ID NO:78), which also corresponds to amino acids 101-457 of HSU40434_P18 (SEQ ID NO:84), wherein said first amino acid sequence and second amino acid sequence are contiguous and in a sequential order.
   B. An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

2. Comparison Report Between HSU40434_P18 (SEQ ID NO:84) and Q96KJ5_HUMAN (SEQ ID NO:79):
   A. An isolated chimeric polypeptide encoding for HSU40434_P18 (SEQ ID NO:84), comprising a first amino acid sequence being at least 90% homologous to MALPTARPLLGSCGTPALGSLLFLLFSLG-WVQPSRTLAGETGQEAAPLDGVLANPPNISSL SPRQLLGFPCAEVSGLSTERVRELAVA-LAQKNVKLSTEQ corresponding to amino acids 1-100 of Q96KJ5_HUMAN (SEQ ID NO:79), which also corresponds to amino acids 1-100 of HSU40434_P18 (SEQ ID NO:84), and a second amino acid sequence being at least 90% homologous to GIVAAWRQRSSRDPSWRQPERTILR-PRFRREVEKTACPSGKKAREIDESLIFYKKWELEAC VDAALLATQMDRVNAIPFTYEQLDVLKH-KLDELYPQGYPESVIQHLGYLFLKMSPEDIRK WNVTSLETLKALLEVNKGHEMSPQ-VATLIDRFVKGRGQLDKDTLDTLTAFYPGYLCSLSPEELSSVPPSSIWAVRPQDLDTCDPRQLD-VLYPKARLAFQNMNGSEYFVKIQSFLGGAPTEDLKALSQQNVSMDLATFMKLRTDAVLPLT-VAEVQKLLGPHVEGLKAEERHRPVRDWILRQ RQD-DLDTLGLGLQGGIPNGYLVLDLSM-QEALSGTPCLLGPGPVLTVLALLLASTLA corresponding to amino acids 266-622 of Q96KJ5_HUMAN (SEQ ID NO:79), which also corresponds to amino acids 101-457 of HSU40434_P18 (SEQ ID NO:84), wherein said first amino acid sequence and second amino acid sequence are contiguous and in a sequential order.

B. An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

3. Comparison Report Between HSU40434_P18 (SEQ ID NO:84) and Q96GR6_HUMAN (SEQ ID NO:72):

A. An isolated chimeric polypeptide encoding for HSU40434_P18 (SEQ ID NO:84), comprising a first amino acid sequence being at least 90% homologous to MALPTAR-PLLGSCGTPALGSLLFLLFSLG-WVQPSRTLAGETGQEAAPLDGVLANPPNISSLSPRQLLGFPCAEVSGLSTERVRELAVA-LAQKNVKLSTEQ corresponding to amino acids 1-100 of Q96GR6_HUMAN (SEQ ID NO:72), which also corresponds to amino acids 1-100 of HSU40434_P18 (SEQ ID NO:84), a second amino acid sequence being at least 90% homologous to GIVAAWRQRSSRDPSWRQPERTILR-PRFRREVEKTACPSGKKA corresponding to amino acids 266-308 of Q96GR6_HUMAN (SEQ ID NO:72), which also corresponds to amino acids 101-143 of HSU40434_P18 (SEQ ID NO:84), a bridging amino acid R corresponding to amino acid 144 of HSU40434_P18 (SEQ ID NO:84), and a third amino acid sequence being at least 90% homologous to EIDESLIFYKKWELEACVDAALLATQM-DRVNAIPFTYEQLDVLKHKLDELYPQGYPESVIQHLGYLFLKMSPEDIRKWNVTSLETLKA-LLEVNKGHEMSPQVATLIDRFVKGRGQLDKDTLDTLTAFYPGYLCSLSPEELSS-VPPSSIWAVRPQDLDTCDPRQLDVLYP-KARLAFQNMNG SEYFVKIQSFLGGAPTEDL-KALSQQNVSMDLATFMKLRTDAVLPLTVAEVQKLLGPHVE GLKAEERHRPVRDWILRQRQD-DLDTLGLGLQGGIPNGYLVLDLSM-QEALSGTPCLLGPGP VLTVLALLLASTLA corresponding to amino acids 310-622 of Q96GR6_HUMAN (SEQ ID NO:72), which also corresponds to amino acids 145-457 of HSU40434_P18 (SEQ ID NO:84), wherein said first amino acid sequence, second amino acid sequence, bridging amino acid and third amino acid sequence are contiguous and in a sequential order.

B. An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

4. Comparison Report Between HSU40434_P18 (SEQ ID NO:84) and Q14859_HUMAN (SEQ ID NO:74):

A. An isolated chimeric polypeptide encoding for HSU40434_P18 (SEQ ID NO:84), comprising a first amino acid sequence being at least 90% homologous to MALPTAR-PLLGSCGTPALGSLLFLLFSLG-WVQPSRTLAGETGQEAAPLDGVLANPPNISSLSPRQLLGFPCAEVSGLSTERVRELAVA-LAQKNVKLSTEQ corresponding to amino acids 1-100 of Q14859_HUMAN (SEQ ID NO:74), which also corresponds to amino acids 1-100 of HSU40434_P18 (SEQ ID NO:84), a second amino acid sequence being at least 90% homologous to GIVAAWRQRSSRDPSWRQPERTILR-PRFRREVEKTACPSGKKAREIDESLIFYKKWELEACVDAALLATQMDRVNAIPFTYEQLDVLKH-KLDELYPQGYPESVIQHLGYLFLKMSPEDIRKWNVTSLETLKALLEVNKGHEMSPQ-VATLIDRFVKGRGQLDKDTLDTLTAFYPGYLCSLSPEELSSVPPSSIWAVRPQDLDTCDPRQLD-VLYPKARLAFQNMNGSEYFVKIQSFLGGAPTEDLKALSQQNVSMDLATFMKLRTDAVLPLT-VAEVQKLLGPHVEGLKAEERHRPVRDWILRQ RQD-DLDTLGLGLQGGIPNGYLVLDLS corresponding to amino acids 266-592 of Q14859_HUMAN (SEQ ID NO:74), which also corresponds to amino acids 101-427 of HSU40434_P18 (SEQ ID NO:84), a bridging amino acid M corresponding to amino acid 428 of HSU40434_P18 (SEQ ID NO:84), and a third amino acid sequence being at least 90% homologous to QEALSGTPCLLGPGPVLTVLA-LLLASTLA corresponding to amino acids 594-622 of Q14859_HUMAN (SEQ ID NO:74), which also corresponds to amino acids 429-457 of HSU40434_P18 (SEQ ID NO:84), wherein said first amino acid sequence, second amino acid sequence, bridging amino acid and third amino acid sequence are contiguous and in a sequential order.

B. An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

5. Comparison Report Between HSU40434_P18 (SEQ ID NO:84) and Q9BTR2_HUMAN (SEQ ID NO:75):

A. An isolated chimeric polypeptide encoding for HSU40434_P18 (SEQ ID NO:84), comprising a first amino acid sequence being at least 90% homologous to MALPTAR-PLLGSCGTPALGSLLFLLFSLGWVQPSRTLAGETGQ corresponding to amino acids 1-43 of Q9BTR2_HUMAN (SEQ ID NO:75), which also corresponds to amino acids 1-43 of HSU40434_P18 (SEQ ID NO:84), a first bridging amino acid E corresponding to amino acid 44 of HSU40434_P18 (SEQ ID NO:84), a second amino acid sequence being at least 90% homologous to AAPLDGVLANPPNISSLSPRQLLG-FPCAEVSGLSTERVRELAVALAQKNVKLSTEQ corresponding to amino acids 44-99 of Q9BTR2_HUMAN (SEQ ID NO:75), which also corresponds to amino acids 45-100 of HSU40434_P18 (SEQ ID NO:84), a third amino acid sequence being at least 90% homologous to GIVAAWRQRSSRDPSWRQPERTILRPRFRREVEKTACPSGKKAREIDESLIFYKKWELEACVDAALLATQMDRVNAIPFTYEQLDVLKH-KLDELYPQGYPESVIQHLGYLFLKMSPEDIRKWNVTSLETLKALLEVNKGHEMSPQ-VATLIDRFVKGRGQLDKDTLDTLTAFYPGYLCSLSPEELSSVPPSSIWAVRPQDLDTCDPRQLD-VLYPKARLAFQNMNGSEYFVKIQSFLGGAPTEDLKALSQQNVSMDLATFMKLRTDAVLPLT-VAEVQKLLGPHVEGLKAEERHRPVRDWILRQ RQD-DLDTLGLGLQGGIPNGYLVLDLS corresponding to amino acids 265-591 of Q9BTR2_HUMAN (SEQ ID NO:75), which also corresponds to amino acids 101-427 of HSU40434_P18 (SEQ ID NO:84), a second bridging amino acid M corresponding to amino acid 428 of HSU40434_P18 (SEQ ID NO:84), and a fourth amino acid sequence being at least 90% homologous to QEALSGTPCLLGPGPVLTVLA-LLLASTLA corresponding to amino acids 593-621 of Q9BTR2_HUMAN (SEQ ID NO:75), which also corresponds to amino acids 429-457 of HSU40434_P18 (SEQ ID NO:84), wherein said first amino acid sequence, first bridging amino acid, second amino acid sequence, third amino acid sequence, second bridging amino acid and fourth amino acid sequence are contiguous and in a sequential order.

B. An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

6. Comparison Report Between HSU40434_P18 (SEQ ID NO:84) and NP_037536 (SEQ ID NO:76):

A. An isolated chimeric polypeptide encoding for HSU40434_P18 (SEQ ID NO:84), comprising a first amino acid sequence being at least 90% homologous to MALPTAR-PLLGSCGTPALGSLLFLLFSLG-WVQPSRTLAGETGQEAAPLDGVLANPPNISSLSPRQLLGFPCAEVSGLSTERVRELAVA-LAQKNVKLSTEQ corresponding to amino acids 1-100 of NP_037536 (SEQ ID NO:76), which also corresponds to amino acids 1-100 of HSU40434_P18 (SEQ ID NO:84), a second amino acid sequence being at least 90% homologous to GIVAAWRQRSSRDPSWRQPERTILR-PRFRREVEKTACPSGKKAREIDESLIFYKKWELEACVDAALLATQMDRVNAIPFTYEQLDVLKH-KLDELYPQGYPESVIQHLGYLFLKMSPEDIRKWNVTSLETLKALLEVNKGHEMSPQ corresponding to amino acids 266-410 of NP_037536 (SEQ ID NO:76), which also corresponds to amino acids 101-245 of HSU40434_P18 (SEQ ID NO:84), and a third amino acid sequence being at least 90% homologous to VATLIDRFVKGRGQLD-KDTLDTLTAFYPGYLCSLSPEELSS-VPPSSIWAVRPQDLDTCDPR QLDVLYPKARLAFQNM-NGSEYFVKIQSFLGGAPTEDLKALSQQNVSMDLATF MKLRTDA VLPLTVAEVQKLLGPHVEGLKAEERHR-PVRDWILRQRQDDLDTLGLGLQGGIPNGYLVL DLSMQEALSGTPCLLGPGPVLTVLALLLASTLA corresponding to amino acids 419-630 of NP_037536 (SEQ ID NO:76), which also corresponds to amino acids 246-457 of HSU40434_P18 (SEQ ID NO:84), wherein said first amino acid sequence, second amino acid sequence and third amino acid sequence are contiguous and in a sequential order.

B. An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

C. An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 245-x to 245; and ending at any of amino acid numbers 246+((n−2)−x), in which x varies from 0 to n−2.

7. Comparison Report Between HSU40434_P18 (SEQ ID NO:84) and Q9BR17_HUMAN (SEQ ID NO:73):

A. An isolated chimeric polypeptide encoding for HSU40434_P18 (SEQ ID NO:84), comprising a first amino acid sequence being at least 90% homologous to MALPTAR-PLLGSCGTPALGSLLFLLFSLG-WVQPSRTLAGETGQEAAPLDGVLANPPNISSLSPRQLLGFPCAEVSGLSTERVRELAVA-LAQKNVKLSTEQ corresponding to amino acids 1-100 of Q9BR17_HUMAN (SEQ ID NO:73), which also corresponds to amino acids 1-100 of HSU40434_P18 (SEQ ID NO:84), a second amino acid sequence being at least 90% homologous to GIVAAWRQRSSRDPSWRQPERTILR-PRFRREVEKTACPSGKKAREIDESLIFYKKWELEACVDAALLATQMDRVNAIPFTYEQLDVLKH-KLDELYPQGYPESVIQHLGYLFLKMSPEDIRKWNVTSLETLKALLEVNKGHEMSPQ corresponding to amino acids 266-410 of Q9BR17_HUMAN (SEQ ID NO:73), which also corresponds to amino acids 101-245 of HSU40434_P18 (SEQ ID NO:84), and a third amino acid sequence being at least 90% homologous to VATLIDRFVKGRGQLDKDTLDTL-TAFYPGYLCSLSPEELSSVPPSSIWAVRPQDLDTCDPR QLDVLYPKARLAFQNMNGSEYFVKIQS-FLGGAPTEDLKALSQQNVSMDLATFMKLRTDA VLPLTVAEVQKLLGPHVEGLKAEERHR-PVRDWILRQRQDDLDTLGLGLQGGIPNGYLVL DLSMQEALSGTPCLLGPGPVLTVLALLLASTLA corresponding to amino acids 419-630 of Q9BR17_HUMAN (SEQ ID NO:73), which also corresponds to amino acids 246-457 of HSU40434_P18 (SEQ ID NO:84), wherein said first amino acid sequence, second amino acid sequence and third amino acid sequence are contiguous and in a sequential order.

B. An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QG, having a structure as follows: a sequence starting from any of amino acid numbers 100-x to 100; and ending at any of amino acid numbers 101+((n−2)−x), in which x varies from 0 to n−2.

C. An isolated chimeric polypeptide encoding for an edge portion of HSU40434_P18 (SEQ ID NO:84), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QV, having a structure as follows: a sequence starting from any of amino acid numbers 245-x to 245; and ending at any of amino acid numbers 246+((n−2)−x), in which x varies from 0 to n−2.

8. Comparison Report Between HSU40434_P18 (SEQ ID NO:84) and Q9UK57_HUMAN (SEQ ID NO:77):

A. An isolated chimeric polypeptide encoding for HSU40434_P18 (SEQ ID NO:84), comprising a first amino acid sequence being at least 70%, optionally at least 80%, preferably at least 85%, more preferably at least 90% and most preferably at least 95%, homologous to a polypeptide having the sequence MALPTARPLLGSCGTPALGSLL-FLLFSLGWVQPSRTLAGETGQEAA-PLDGVLANPPNISSL SPRQLLGFPCAEVSGLSTER-VRELAVALAQKNVKLSTEQGIVAAWRQRSSRDPSWR QPER TILRPRFRRE (SEQ ID NO:544) corresponding to amino acids 1-131 of HSU40434_P18 (SEQ ID NO:84), a second amino acid sequence being at least 90% homologous to VEKTACPSGKKAREIDESLIFYKKWE-LEACVDAALLATQMDRVNAIPFTYEQLDVLKHKL DELYPQGYPESVIQHLGYLFLKMS-PEDIRKWNVTSLETLKALLEVNKGHEMSPQVATLID RFVKGRGQLDKDTLDTLTAFYPGYLCSL-SPEELSSVPPSSIWAVRPQDLDTCDPRQLDVLY PKAR-LAFQNMNGSEYFVKIQSFLGGAPTEDL-KALSQQNVSMDLATFMKLRTDAVLPLTV AEVQKLLGPHVEGLKAEERHRPVRDWIL-RQRQDDLDTLGLGLQGGIPNGYLVLDLS corresponding to amino acids 1-296 of Q9UK57_HUMAN (SEQ ID NO:77), which also corresponds to amino acids 132-427 of HSU40434_P18 (SEQ ID NO:84), a first bridging amino acid M corresponding to amino acid 428 of HSU40434_P18 (SEQ ID NO:84), a second bridging amino acid Q corresponding to amino acid 298 of Q9UK57_HUMAN (SEQ ID NO:77), which also corresponds to amino acid 429 of HSU40434_P18 (SEQ ID NO:84), and a fourth amino acid sequence being at least 70%, optionally at least 80%, preferably at least 85%, more preferably at least 90% and most preferably at least 95% homologous to a polypeptide having the sequence EALSGT-PCLLGPGPVLTVLALLLASTLA (SEQ ID NO:532) corresponding to amino acids 430-457 of HSU40434_P18 (SEQ ID NO:84), wherein said first amino acid sequence, second amino acid sequence, first bridging amino acid, second bridging amino acid and third amino acid sequence are contiguous and in a sequential order.

B. An isolated polypeptide encoding for a head of HSU40434_P18 (SEQ ID NO:84), comprising a polypeptide being at least 70%, optionally at least about 80%, preferably at least about 85%, more preferably at least about 90% and most preferably at least about 95% homologous to the sequence MALPTARPLLGSCGTPALGSLLFLLFS-LGWVQPSRTLAGETGQEAAPLDGVLANPPNISSL SPRQLLGFPCAEVSGLSTERVRELAVA-LAQKNVKLSTEQGIVAAWRQRSSRDPSWRQPER TIL-RPRFRRE (SEQ ID NO:544) of HSU40434_P18 (SEQ ID NO:84).

C. An isolated polypeptide encoding for an edge portion of HSU40434_P18 (SEQ ID NO:84), comprising an amino acid sequence being at least 70%, optionally at least about 80%, preferably at least about 85%, more preferably at least about 90% and most preferably at least about 95% homologous to the sequence EALSGTPCLLGPGPVLTVLALLLASTLA (SEQ ID NO:532) of HSU40434_P18 (SEQ ID NO:84).

The localization of the variant protein was determined according to results from a number of different software programs and analyses, including analyses from SignalP and other specialized programs. The variant protein is believed to be located as follows with regard to the cell: membrane.

Variant protein HSU40434_P18 (SEQ ID NO:84) also has the following non-silent SNPs (Single Nucleotide Polymorphisms) as listed in Table 63, (given according to their position(s) on the amino acid sequence, with the alternative amino acid(s) listed; the last column indicates whether the SNP is known or not; the presence of known SNPs in variant protein HSU40434_P18 (SEQ ID NO:84) sequence provides support for the deduced sequence of this variant protein according to the present invention).

TABLE 63

| SNP position(s) on amino acid sequence | Amino acid mutations Alternative amino acid(s) | Previously known SNP? |
|---|---|---|
| 51 | V -> | No |
| 160 | A -> | No |
| 160 | A -> P | No |
| 165 | A -> V | No |
| 177 | I -> N | No |
| 261 | D -> | No |
| 315 | A -> | No |
| 323 | N -> D | No |
| 428 | M -> V | No |

The glycosylation sites of variant protein HSU40434_P18 (SEQ ID NO:84), as compared to the known protein Mesothelin precursor (SEQ ID NO:71), are described in Table 64 (given according to their position(s) on the amino acid sequence in the first column; the second column indicates whether the glycosylation site is present in the variant protein; and the last column indicates whether the position is different on the variant protein).

TABLE 64

| Glycosylation site(s) | | |
|---|---|---|
| Position(s) on known amino acid sequence | Present in variant protein? | Position(s) on variant protein |
| 67 | Yes | 68 |
| 233 | Yes | 234 |
| 333 | Yes | 334 |
| 360 | Yes | 361 |

The variant protein has the following domains, as determined by using InterPro. The domains are described in Table 65:

TABLE 65

| InterPro domain(s) | | |
|---|---|---|
| Domain description | Analysis type | Position(s) on protein |
| Pre-pro-megakaryocyte potentiating factor precursor | HMMPfam | 1-457 |
| Hemopexin | ScanRegExp | 152-166 |

Variant protein HSU40434_P18 (SEQ ID NO:84) is encoded by the following transcript(s): HSU40434_T19 (SEQ ID NO:33), for which the sequence(s) is/are given at the end of the application. The coding portion of transcript HSU40434_T19 (SEQ ID NO:33) is shown in bold; this coding portion starts at position 419 and ends at position 1789. The transcript also has the following SNPs as listed in Table 66 (given according to their position on the nucleotide sequence, with the alternative nucleic acid listed; the last column indicates whether the SNP is known or not; the presence of known SNPs in variant protein HSU40434_P18 (SEQ ID NO:84) sequence provides support for the deduced sequence of this variant protein according to the present invention).

TABLE 66

| Nucleic acid SNPs | | |
|---|---|---|
| SNP position(s) on nucleotide sequence | Alternative nucleic acid(s) | Previously known SNP? |
| 169 | G -> A | Yes |
| 333 | G -> A | Yes |
| 556 | G -> A | No |
| 571 | C -> | No |
| 896 | G -> C | No |
| 896 | G -> | No |
| 912 | C -> T | No |
| 948 | T -> A | No |
| 1200 | A -> | No |
| 1361 | G -> | No |
| 1385 | A -> G | No |
| 1700 | A -> G | No |
| 1861 | G -> A | No |

As noted above, cluster HSU40434 features 37 segment(s), which were listed in Table 43 above and for which the sequence(s) are given at the end of the application. These segment(s) are portions of nucleic acid sequence(s) which are described herein separately because they are of particular interest. A description of each segment according to the present invention is now provided.

Segment cluster HSU40434_N1 (SEQ ID NO:34) according to the present invention is supported by 7 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 67 below describes the starting and ending position of this segment on each transcript.

TABLE 67

| Segment location on transcripts | | |
|---|---|---|
| Transcript name | Segment starting position | Segment ending position |
| HSU40434_T12 (SEQ ID NO: 30) | 57 | 307 |
| HSU40434_T15 (SEQ ID NO: 31) | 57 | 307 |
| HSU40434_T17 (SEQ ID NO: 32) | 57 | 307 |
| HSU40434_T19 (SEQ ID NO: 33) | 57 | 307 |
| HSU40434_T8 (SEQ ID NO: 29) | 57 | 307 |

Segment cluster HSU40434_N17 (SEQ ID NO:35) according to the present invention is supported by 38 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 68 below describes the starting and ending position of this segment on each transcript.

TABLE 68

| Segment location on transcripts | | |
|---|---|---|
| Transcript name | Segment starting position | Segment ending position |
| HSU40434_T12 (SEQ ID NO: 30) | 598 | 718 |
| HSU40434_T15 (SEQ ID NO: 31) | 598 | 718 |
| HSU40434_T17 (SEQ ID NO: 32) | 598 | 718 |
| HSU40434_T19 (SEQ ID NO: 33) | 598 | 718 |
| HSU40434_T8 (SEQ ID NO: 29) | 598 | 718 |

Segment cluster HSU40434_N31 (SEQ ID NO:36) according to the present invention is supported by 41 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 69 below describes the starting and ending position of this segment on each transcript.

TABLE 69

| Segment location on transcripts | | |
|---|---|---|
| Transcript name | Segment starting position | Segment ending position |
| HSU40434_T12 (SEQ ID NO: 30) | 1143 | 1321 |
| HSU40434_T15 (SEQ ID NO: 31) | 1029 | 1207 |
| HSU40434_T17 (SEQ ID NO: 32) | 1314 | 1492 |
| HSU40434_T19 (SEQ ID NO: 33) | 819 | 997 |
| HSU40434_T8 (SEQ ID NO: 29) | 1314 | 1492 |

Segment cluster HSU40434_N33 (SEQ ID NO:37) according to the present invention is supported by 52 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 70 below describes the starting and ending position of this segment on each transcript.

TABLE 70

Segment location on transcripts

| Transcript name | Segment starting position | Segment ending position |
|---|---|---|
| HSU40434_T12 (SEQ ID NO: 30) | 1322 | 1477 |
| HSU40434_T15 (SEQ ID NO: 31) | 1208 | 1363 |
| HSU40434_T17 (SEQ ID NO: 32) | 1493 | 1648 |
| HSU40434_T19 (SEQ ID NO: 33) | 998 | 1153 |
| HSU40434_T8 (SEQ ID NO: 29) | 1493 | 1648 |

Segment cluster HSU40434_N58 (SEQ ID NO:38) according to the present invention is supported by 64 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 71 below describes the starting and ending position of this segment on each transcript.

TABLE 71

Segment location on transcripts

| Transcript name | Segment starting position | Segment ending position |
|---|---|---|
| HSU40434_T12 (SEQ ID NO: 30) | 2061 | 2248 |
| HSU40434_T15 (SEQ ID NO: 31) | 1947 | 2134 |
| HSU40434_T17 (SEQ ID NO: 32) | 2007 | 2194 |
| HSU40434_T19 (SEQ ID NO: 33) | 1737 | 1924 |
| HSU40434_T8 (SEQ ID NO: 29) | 2306 | 2493 |

According to an optional embodiment of the present invention, short segments related to the above cluster are also provided. These segments are up to about 120 bp in length, and so are included in a separate description.

Segment cluster HSU40434_N0 (SEQ ID NO:39) according to the present invention is supported by 6 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 72 below describes the starting and ending position of this segment on each transcript.

TABLE 72

Segment location on transcripts

| Transcript name | Segment starting position | Segment ending position |
|---|---|---|
| HSU40434_T12 (SEQ ID NO: 30) | 1 | 56 |
| HSU40434_T15 (SEQ ID NO: 31) | 1 | 56 |
| HSU40434_T17 (SEQ ID NO: 32) | 1 | 56 |
| HSU40434_T19 (SEQ ID NO: 33) | 1 | 56 |
| HSU40434_T8 (SEQ ID NO: 29) | 1 | 56 |

Segment cluster HSU40434_N2 (SEQ ID NO:40) according to the present invention is supported by 14 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 73 below describes the starting and ending position of this segment on each transcript.

TABLE 73

Segment location on transcripts

| Transcript name | Segment starting position | Segment ending position |
|---|---|---|
| HSU40434_T12 (SEQ ID NO: 30) | 308 | 367 |
| HSU40434_T15 (SEQ ID NO: 31) | 308 | 367 |
| HSU40434_T17 (SEQ ID NO: 32) | 308 | 367 |
| HSU40434_T19 (SEQ ID NO: 33) | 308 | 367 |
| HSU40434_T8 (SEQ ID NO: 29) | 308 | 367 |

Segment cluster HSU40434_N3 (SEQ ID NO:41) according to the present invention is supported by 25 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 74 below describes the starting and ending position of this segment on each transcript.

TABLE 74

Segment location on transcripts

| Transcript name | Segment starting position | Segment ending position |
|---|---|---|
| HSU40434_T12 (SEQ ID NO: 30) | 368 | 409 |
| HSU40434_T15 (SEQ ID NO: 31) | 368 | 409 |
| HSU40434_T17 (SEQ ID NO: 32) | 368 | 409 |
| HSU40434_T19 (SEQ ID NO: 33) | 368 | 409 |
| HSU40434_T8 (SEQ ID NO: 29) | 368 | 409 |

Segment cluster HSU40434_N7 (SEQ ID NO:42) according to the present invention is supported by 36 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 75 below describes the starting and ending position of this segment on each transcript.

TABLE 75

Segment location on transcripts

| Transcript name | Segment starting position | Segment ending position |
|---|---|---|
| HSU40434_T12 (SEQ ID NO: 30) | 410 | 463 |
| HSU40434_T15 (SEQ ID NO: 31) | 410 | 463 |
| HSU40434_T17 (SEQ ID NO: 32) | 410 | 463 |
| HSU40434_T19 (SEQ ID NO: 33) | 410 | 463 |
| HSU40434_T8 (SEQ ID NO: 29) | 410 | 463 |

Segment cluster HSU40434_N8 (SEQ ID NO:43) according to the present invention is supported by 36 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 76 below describes the starting and ending position of this segment on each transcript.

TABLE 76

Segment location on transcripts

| Transcript name | Segment starting position | Segment ending position |
|---|---|---|
| HSU40434_T12 (SEQ ID NO: 30) | 464 | 503 |
| HSU40434_T15 (SEQ ID NO: 31) | 464 | 503 |
| HSU40434_T17 (SEQ ID NO: 32) | 464 | 503 |
| HSU40434_T19 (SEQ ID NO: 33) | 464 | 503 |
| HSU40434_T8 (SEQ ID NO: 29) | 464 | 503 |

Segment cluster HSU40434_N10 (SEQ ID NO:44) according to the present invention is supported by 36 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 77 below describes the starting and ending position of this segment on each transcript.

TABLE 77

Segment location on transcripts

| Transcript name | Segment starting position | Segment ending position |
|---|---|---|
| HSU40434_T12 (SEQ ID NO: 30) | 504 | 547 |
| HSU40434_T15 (SEQ ID NO: 31) | 504 | 547 |
| HSU40434_T17 (SEQ ID NO: 32) | 504 | 547 |
| HSU40434_T19 (SEQ ID NO: 33) | 504 | 547 |
| HSU40434_T8 (SEQ ID NO: 29) | 504 | 547 |

Segment cluster HSU40434_N13 (SEQ ID NO:45) according to the present invention is supported by 34 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 78 below describes the starting and ending position of this segment on each transcript.

TABLE 78

Segment location on transcripts

| Transcript name | Segment starting position | Segment ending position |
|---|---|---|
| HSU40434_T12 (SEQ ID NO: 30) | 548 | 550 |
| HSU40434_T15 (SEQ ID NO: 31) | 548 | 550 |
| HSU40434_T17 (SEQ ID NO: 32) | 548 | 550 |
| HSU40434_T19 (SEQ ID NO: 33) | 548 | 550 |
| HSU40434_T8 (SEQ ID NO: 29) | 548 | 550 |

Segment cluster HSU40434_N14 (SEQ ID NO:46) according to the present invention is supported by 35 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 79 below describes the starting and ending position of this segment on each transcript.

TABLE 79

Segment location on transcripts

| Transcript name | Segment starting position | Segment ending position |
|---|---|---|
| HSU40434_T12 (SEQ ID NO: 30) | 551 | 597 |
| HSU40434_T15 (SEQ ID NO: 31) | 551 | 597 |
| HSU40434_T17 (SEQ ID NO: 32) | 551 | 597 |
| HSU40434_T19 (SEQ ID NO: 33) | 551 | 597 |
| HSU40434_T8 (SEQ ID NO: 29) | 551 | 597 |

Segment cluster HSU40434_N19 (SEQ ID NO:47) according to the present invention is supported by 38 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32) and HSU40434_T8 (SEQ ID NO:29). Table 80 below describes the starting and ending position of this segment on each transcript.

TABLE 80

Segment location on transcripts

| Transcript name | Segment starting position | Segment ending position |
|---|---|---|
| HSU40434_T12 (SEQ ID NO: 30) | 719 | 798 |
| HSU40434_T15 (SEQ ID NO: 31) | 719 | 798 |
| HSU40434_T17 (SEQ ID NO: 32) | 719 | 798 |
| HSU40434_T8 (SEQ ID NO: 29) | 719 | 798 |

Segment cluster HSU40434_N21 (SEQ ID NO:48) according to the present invention is supported by 37 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32) and HSU40434_T8 (SEQ ID NO:29). Table 81 below describes the starting and ending position of this segment on each transcript.

TABLE 81

Segment location on transcripts

| Transcript name | Segment starting position | Segment ending position |
|---|---|---|
| HSU40434_T12 (SEQ ID NO: 30) | 799 | 904 |
| HSU40434_T15 (SEQ ID NO: 31) | 799 | 904 |
| HSU40434_T17 (SEQ ID NO: 32) | 799 | 904 |
| HSU40434_T8 (SEQ ID NO: 29) | 799 | 904 |

Segment cluster HSU40434_N22 (SEQ ID NO:49) according to the present invention is supported by 34 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32) and HSU40434_T8 (SEQ ID NO:29). Table 82 below describes the starting and ending position of this segment on each transcript.

TABLE 82

Segment location on transcripts

| Transcript name | Segment starting position | Segment ending position |
|---|---|---|
| HSU40434_T12 (SEQ ID NO: 30) | 905 | 928 |
| HSU40434_T15 (SEQ ID NO: 31) | 905 | 928 |
| HSU40434_T17 (SEQ ID NO: 32) | 905 | 928 |
| HSU40434_T8 (SEQ ID NO: 29) | 905 | 928 |

Segment cluster HSU40434_N24 (SEQ ID NO:50) according to the present invention is supported by 34 libraries. The number of libraries was determined as previously described. This segment can be found in the following transcript(s): HSU40434_T12 (SEQ ID NO:30), HSU40434_T17 (SEQ ID NO:32) and HSU40434_T8 (SEQ ID NO:29). Table 83 below describes the starting and ending position of this segment on each transcript.

TABLE 83

Segment location on transcripts

| Transcript name | Segment starting position | Segment ending position |
|---|---|---|
| HSU40434_T12 (SEQ ID NO: 30) | 929 | 1042 |
| HSU40434_T17 (SEQ ID NO: 32) | 929 | 1042 |
| HSU40434_T8 (SEQ ID NO: 29) | 929 | 1042 |

Segment cluster HSU40434_N25 (SEQ ID NO:51) according to the present invention is supported by 32 libraries. The number of libraries was determined as previously described. This segment can be found in the following transcript(s): HSU40434_T17 (SEQ ID NO:32) and HSU40434_T8 (SEQ ID NO:29). Table 84 below describes the starting and ending position of this segment on each transcript.

TABLE 84

Segment location on transcripts

| Transcript name | Segment starting position | Segment ending position |
|---|---|---|
| HSU40434_T17 (SEQ ID NO: 32) | 1043 | 1122 |
| HSU40434_T8 (SEQ ID NO: 29) | 1043 | 1122 |

Segment cluster HSU40434_N27 (SEQ ID NO:52) according to the present invention is supported by 34 libraries. The number of libraries was determined as previously described. This segment can be found in the following transcript(s): HSU40434_T17 (SEQ ID NO:32) and HSU40434_T8 (SEQ ID NO:29). Table 85 below describes the starting and ending position of this segment on each transcript.

TABLE 85

Segment location on transcripts

| Transcript name | Segment starting position | Segment ending position |
|---|---|---|
| HSU40434_T17 (SEQ ID NO: 32) | 1123 | 1213 |
| HSU40434_T8 (SEQ ID NO: 29) | 1123 | 1213 |

Segment cluster HSU40434_N29 (SEQ ID NO:53) according to the present invention is supported by 36 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 86 below describes the starting and ending position of this segment on each transcript.

TABLE 86

Segment location on transcripts

| Transcript name | Segment starting position | Segment ending position |
|---|---|---|
| HSU40434_T12 (SEQ ID NO: 30) | 1043 | 1142 |
| HSU40434_T15 (SEQ ID NO: 31) | 929 | 1028 |
| HSU40434_T17 (SEQ ID NO: 32) | 1214 | 1313 |
| HSU40434_T19 (SEQ ID NO: 33) | 719 | 818 |
| HSU40434_T8 (SEQ ID NO: 29) | 1214 | 1313 |

Segment cluster HSU40434_N36 (SEQ ID NO:54) according to the present invention is supported by 49 libraries. The number of libraries was determined as previously described. This segment can be found in the following transcript(s): HSU40434_T12 (SEQ ID NO:30), HSU40434_T15 (SEQ ID NO:31), HSU40434_T19 (SEQ ID NO:33) and HSU40434_T8 (SEQ ID NO:29). Table 87 below describes the starting and ending position of this segment on each transcript.

TABLE 87

Segment location on transcripts

| Transcript name | Segment starting position | Segment ending position |
|---|---|---|
| HSU40434_T12 (SEQ ID NO: 30) | 1478 | 1507 |
| HSU40434_T15 (SEQ ID NO: 31) | 1364 | 1393 |
| HSU40434_T19 (SEQ ID NO: 33) | 1154 | 1183 |
| HSU40434_T8 (SEQ ID NO: 29) | 1649 | 1678 |

Segment cluster HSU40434_N37 (SEQ ID NO:55) according to the present invention is supported by 57 libraries. The number of libraries was determined as previously described. This segment can be found in the following transcript(s): HSU40434_T12 (SEQ ID NO:30), HSU40434_T15 (SEQ ID NO:31), HSU40434_T19 (SEQ ID NO:33) and HSU40434_T8 (SEQ ID NO:29). Table 88 below describes the starting and ending position of this segment on each transcript.

TABLE 88

Segment location on transcripts

| Transcript name | Segment starting position | Segment ending position |
|---|---|---|
| HSU40434_T12 (SEQ ID NO: 30) | 1508 | 1581 |
| HSU40434_T15 (SEQ ID NO: 31) | 1394 | 1467 |
| HSU40434_T19 (SEQ ID NO: 33) | 1184 | 1257 |
| HSU40434_T8 (SEQ ID NO: 29) | 1679 | 1752 |

Segment cluster HSU40434_N38 (SEQ ID NO:56) according to the present invention is supported by 54 libraries. The number of libraries was determined as previously described. This segment can be found in the following transcript(s): HSU40434_T12 (SEQ ID NO:30), HSU40434_T15 (SEQ ID NO:31), HSU40434_T19 (SEQ ID NO:33) and HSU40434_T8 (SEQ ID NO:29). Table 89 below describes the starting and ending position of this segment on each transcript.

TABLE 89

Segment location on transcripts

| Transcript name | Segment starting position | Segment ending position |
|---|---|---|
| HSU40434_T12 (SEQ ID NO: 30) | 1582 | 1620 |
| HSU40434_T15 (SEQ ID NO: 31) | 1468 | 1506 |
| HSU40434_T19 (SEQ ID NO: 33) | 1258 | 1296 |
| HSU40434_T8 (SEQ ID NO: 29) | 1753 | 1791 |

Segment cluster HSU40434_N39 (SEQ ID NO:57) according to the present invention is supported by 1 libraries. The number of libraries was determined as previously described. This segment can be found in the following transcript(s): HSU40434_T8 (SEQ ID NO:29). Table 90 below describes the starting and ending position of this segment on each transcript.

TABLE 90

Segment location on transcripts

| Transcript name | Segment starting position | Segment ending position |
|---|---|---|
| HSU40434_T8 (SEQ ID NO: 29) | 1792 | 1865 |

Segment cluster HSU40434_N40 (SEQ ID NO:58) according to the present invention is supported by 53 libraries. The number of libraries was determined as previously described. This segment can be found in the following transcript(s): HSU40434_T12 (SEQ ID NO:30), HSU40434_T15 (SEQ ID NO:31), HSU40434_T19 (SEQ ID NO:33) and HSU40434_T8 (SEQ ID NO:29). Table 91 below describes the starting and ending position of this segment on each transcript.

TABLE 91

Segment location on transcripts

| Transcript name | Segment starting position | Segment ending position |
|---|---|---|
| HSU40434_T12 (SEQ ID NO: 30) | 1621 | 1663 |
| HSU40434_T15 (SEQ ID NO: 31) | 1507 | 1549 |
| HSU40434_T19 (SEQ ID NO: 33) | 1297 | 1339 |
| HSU40434_T8 (SEQ ID NO: 29) | 1866 | 1908 |

Segment cluster HSU40434_N41 (SEQ ID NO:59) according to the present invention is supported by 51 libraries. The number of libraries was determined as previously described. This segment can be found in the following transcript(s): HSU40434_T12 (SEQ ID NO:30), HSU40434_T15 (SEQ ID NO:31), HSU40434_T19 (SEQ ID NO:33) and HSU40434_T8 (SEQ ID NO:29). Table 92 below describes the starting and ending position of this segment on each transcript.

TABLE 92

Segment location on transcripts

| Transcript name | Segment starting position | Segment ending position |
|---|---|---|
| HSU40434_T12 (SEQ ID NO: 30) | 1664 | 1684 |
| HSU40434_T15 (SEQ ID NO: 31) | 1550 | 1570 |
| HSU40434_T19 (SEQ ID NO: 33) | 1340 | 1360 |
| HSU40434_T8 (SEQ ID NO: 29) | 1909 | 1929 |

Segment cluster HSU40434_N42 (SEQ ID NO:60) according to the present invention is supported by 53 libraries. The number of libraries was determined as previously described. This segment can be found in the following transcript(s): HSU40434_T12 (SEQ ID NO:30), HSU40434_T15 (SEQ ID NO:31), HSU40434_T19 (SEQ ID NO:33) and HSU40434_T8 (SEQ ID NO:29). Table 93 below describes the starting and ending position of this segment on each transcript.

TABLE 93

Segment location on transcripts

| Transcript name | Segment starting position | Segment ending position |
|---|---|---|
| HSU40434_T12 (SEQ ID NO: 30) | 1685 | 1702 |
| HSU40434_T15 (SEQ ID NO: 31) | 1571 | 1588 |
| HSU40434_T19 (SEQ ID NO: 33) | 1361 | 1378 |
| HSU40434_T8 (SEQ ID NO: 29) | 1930 | 1947 |

Segment cluster HSU40434_N43 (SEQ ID NO:61) according to the present invention is supported by 55 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 94 below describes the starting and ending position of this segment on each transcript.

TABLE 94

Segment location on transcripts

| Transcript name | Segment starting position | Segment ending position |
|---|---|---|
| HSU40434_T12 (SEQ ID NO: 30) | 1703 | 1732 |
| HSU40434_T15 (SEQ ID NO: 31) | 1589 | 1618 |
| HSU40434_T17 (SEQ ID NO: 32) | 1649 | 1678 |
| HSU40434_T19 (SEQ ID NO: 33) | 1379 | 1408 |
| HSU40434_T8 (SEQ ID NO: 29) | 1948 | 1977 |

Segment cluster HSU40434_N44 (SEQ ID NO:62) according to the present invention is supported by 56 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 95 below describes the starting and ending position of this segment on each transcript.

TABLE 95

Segment location on transcripts

| Transcript name | Segment starting position | Segment ending position |
|---|---|---|
| HSU40434_T12 (SEQ ID NO: 30) | 1733 | 1744 |
| HSU40434_T15 (SEQ ID NO: 31) | 1619 | 1630 |
| HSU40434_T17 (SEQ ID NO: 32) | 1679 | 1690 |
| HSU40434_T19 (SEQ ID NO: 33) | 1409 | 1420 |
| HSU40434_T8 (SEQ ID NO: 29) | 1978 | 1989 |

Segment cluster HSU40434_N45 (SEQ ID NO:63) according to the present invention is supported by 55 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 96 below describes the starting and ending position of this segment on each transcript.

TABLE 96

Segment location on transcripts

| Transcript name | Segment starting position | Segment ending position |
|---|---|---|
| HSU40434_T12 (SEQ ID NO: 30) | 1745 | 1748 |
| HSU40434_T15 (SEQ ID NO: 31) | 1631 | 1634 |
| HSU40434_T17 (SEQ ID NO: 32) | 1691 | 1694 |
| HSU40434_T19 (SEQ ID NO: 33) | 1421 | 1424 |
| HSU40434_T8 (SEQ ID NO: 29) | 1990 | 1993 |

Segment cluster HSU40434_N48 (SEQ ID NO:64) according to the present invention is supported by 59 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 97 below describes the starting and ending position of this segment on each transcript.

TABLE 97

Segment location on transcripts

| Transcript name | Segment starting position | Segment ending position |
|---|---|---|
| HSU40434_T12 (SEQ ID NO: 30) | 1749 | 1786 |
| HSU40434_T15 (SEQ ID NO: 31) | 1635 | 1672 |
| HSU40434_T17 (SEQ ID NO: 32) | 1695 | 1732 |
| HSU40434_T19 (SEQ ID NO: 33) | 1425 | 1462 |
| HSU40434_T8 (SEQ ID NO: 29) | 1994 | 2031 |

Segment cluster HSU40434_N49 (SEQ ID NO:65) according to the present invention is supported by 60 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 98 below describes the starting and ending position of this segment on each transcript.

TABLE 98

Segment location on transcripts

| Transcript name | Segment starting position | Segment ending position |
|---|---|---|
| HSU40434_T12 (SEQ ID NO: 30) | 1787 | 1843 |
| HSU40434_T15 (SEQ ID NO: 31) | 1673 | 1729 |
| HSU40434_T17 (SEQ ID NO: 32) | 1733 | 1789 |
| HSU40434_T19 (SEQ ID NO: 33) | 1463 | 1519 |
| HSU40434_T8 (SEQ ID NO: 29) | 2032 | 2088 |

Segment cluster HSU40434_N52 (SEQ ID NO:66) according to the present invention is supported by 61 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 99 below describes the starting and ending position of this segment on each transcript.

TABLE 99

Segment location on transcripts

| Transcript name | Segment starting position | Segment ending position |
|---|---|---|
| HSU40434_T12 (SEQ ID NO: 30) | 1844 | 1867 |
| HSU40434_T15 (SEQ ID NO: 31) | 1730 | 1753 |
| HSU40434_T17 (SEQ ID NO: 32) | 1790 | 1813 |
| HSU40434_T19 (SEQ ID NO: 33) | 1520 | 1543 |
| HSU40434_T8 (SEQ ID NO: 29) | 2089 | 2112 |

Segment cluster HSU40434_N53 (SEQ ID NO:67) according to the present invention is supported by 65 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 100 below describes the starting and ending position of this segment on each transcript.

TABLE 100

Segment location on transcripts

| Transcript name | Segment starting position | Segment ending position |
|---|---|---|
| HSU40434_T12 (SEQ ID NO: 30) | 1868 | 1900 |
| HSU40434_T15 (SEQ ID NO: 31) | 1754 | 1786 |
| HSU40434_T17 (SEQ ID NO: 32) | 1814 | 1846 |
| HSU40434_T19 (SEQ ID NO: 33) | 1544 | 1576 |
| HSU40434_T8 (SEQ ID NO: 29) | 2113 | 2145 |

Segment cluster HSU40434_N54 (SEQ ID NO:68) according to the present invention is supported by 67 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 101 below describes the starting and ending position of this segment on each transcript.

TABLE 101

Segment location on transcripts

| Transcript name | Segment starting position | Segment ending position |
|---|---|---|
| HSU40434_T12 (SEQ ID NO: 30) | 1901 | 1951 |
| HSU40434_T15 (SEQ ID NO: 31) | 1787 | 1837 |
| HSU40434_T17 (SEQ ID NO: 32) | 1847 | 1897 |
| HSU40434_T19 (SEQ ID NO: 33) | 1577 | 1627 |
| HSU40434_T8 (SEQ ID NO: 29) | 2146 | 2196 |

Segment cluster HSU40434_N55 (SEQ ID NO:69) according to the present invention is supported by 68 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 102 below describes the starting and ending position of this segment on each transcript.

TABLE 102

Segment location on transcripts

| Transcript name | Segment starting position | Segment ending position |
|---|---|---|
| HSU40434_T12 (SEQ ID NO: 30) | 1952 | 2030 |
| HSU40434_T15 (SEQ ID NO: 31) | 1838 | 1916 |
| HSU40434_T17 (SEQ ID NO: 32) | 1898 | 1976 |
| HSU40434_T19 (SEQ ID NO: 33) | 1628 | 1706 |
| HSU40434_T8 (SEQ ID NO: 29) | 2197 | 2275 |

Segment cluster HSU40434_N57 (SEQ ID NO:70) according to the present invention is supported by 59 libraries. The number of libraries was determined as previously described. This segment can be found in the following transcript(s): HSU40434_T12 (SEQ ID NO:30), HSU40434_T15 (SEQ ID NO:31), HSU40434_T17 (SEQ ID NO:32), HSU40434_T19 (SEQ ID NO:33) and HSU40434_T8 (SEQ ID NO:29). Table 103 below describes the starting and ending position of this segment on each transcript.

TABLE 103

Segment location on transcripts

| Transcript name | Segment starting position | Segment ending position |
|---|---|---|
| HSU40434_T12 (SEQ ID NO: 30) | 2031 | 2060 |
| HSU40434_T15 (SEQ ID NO: 31) | 1917 | 1946 |
| HSU40434_T17 (SEQ ID NO: 32) | 1977 | 2006 |
| HSU40434_T19 (SEQ ID NO: 33) | 1707 | 1736 |
| HSU40434_T8 (SEQ ID NO: 29) | 2276 | 2305 |

The alignment of HSU40434 variant proteins to the previously known proteins is shown in the attached CD-Rom.

Expression of *Homo sapiens* Mesothelin (MSLN) HSU40434 Transcripts which are Detectable by Amplicon as Depicted in Sequence Name HSU40434 seg37-38 (SEQ ID NO:471) in Normal and Cancerous Lung Tissues:

Expression of *Homo sapiens* mesothelin (MSLN) transcripts detectable by or according to seg37-38—HSU40434 seg37-38 (SEQ ID NO:471) amplicon and primers HSU40434 seg37-38F (SEQ ID NO:469) and HSU40434 seg37-38R (SEQ ID NO:470) was measured by real time PCR. In parallel the expression of four housekeeping genes—PBGD (GenBank Accession No. BCO19323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), Ubiquitin (GenBank Accession No. BC000449 (SEQ ID NO:458); amplicon—Ubiquitin-amplicon (SEQ ID NO:461)) and SDHA (GenBank Accession No. NM_004168 (SEQ ID NO:462); amplicon—SDHA-amplicon (SEQ ID NO:465)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2_4, above), to obtain a value of fold up-regulation for each sample relative to median of the normal PM samples.

Figure 10:
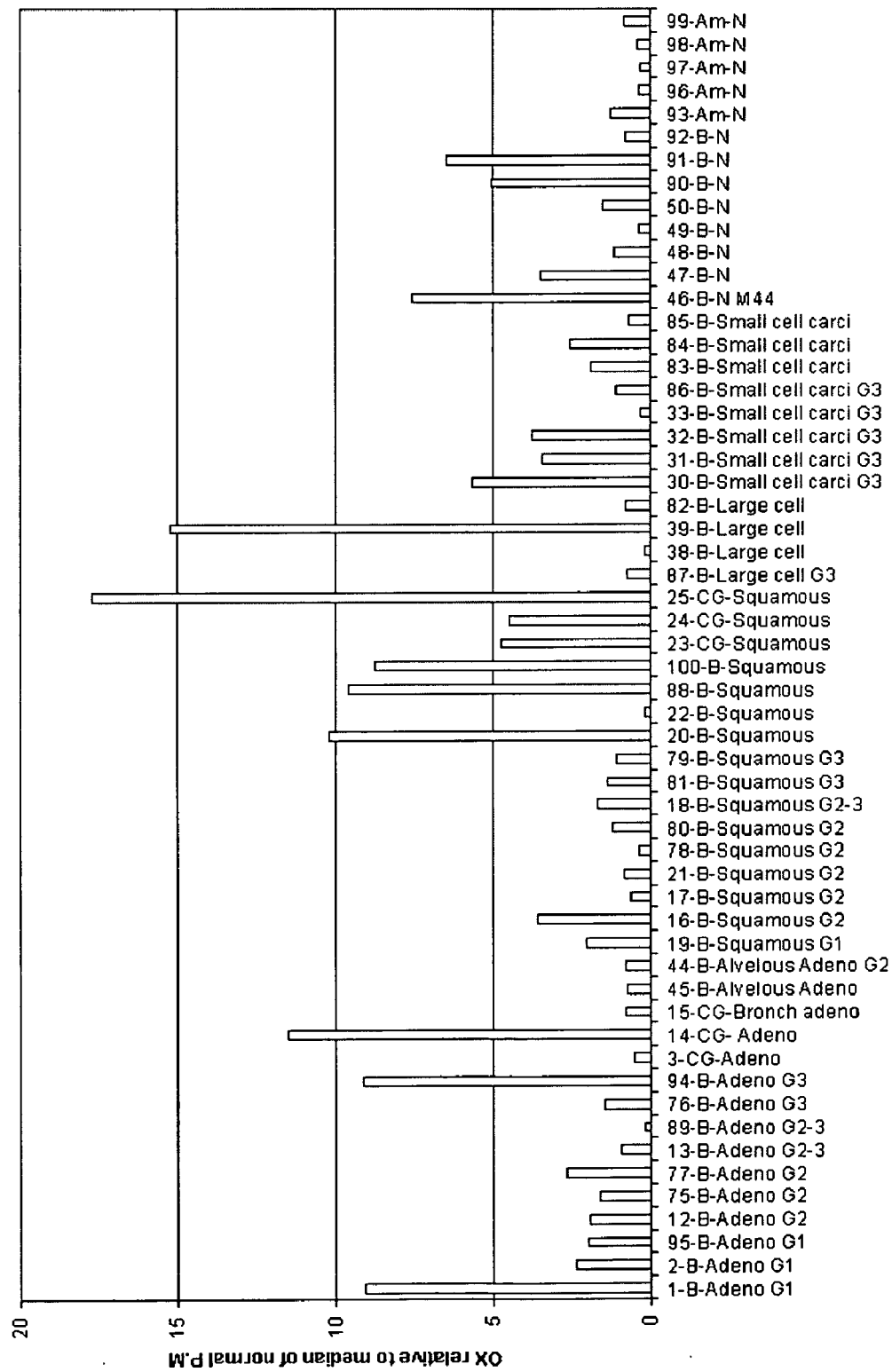
FIG. 10 is a histogram showing Expression of *Homo sapiens* mesothelin (MSLN) HSU40434 transcripts which are detectable by amplicon as depicted in sequence name HSU40434 seg37-38 (SEQ ID NO:471) in normal and cancerous lung tissues.

FIG. 10 is a histogram showing over expression of the above-indicated *Homo sapiens* mesothelin (MSLN) transcripts in cancerous Lung samples relative to the normal samples.

As is evident from FIG. 10, the expression of *Homo sapiens* mesothelin (MSLN) transcripts detectable by the above amplicon was higher in several cancer samples than in the non-cancerous samples (Sample Nos. 46-50, 90-93, 96-99 Table 2_4). Notably an over-expression of at least 5 fold was found in 3 out of 15 adenocarcinoma samples, 4 out of 16 squamous cell carcinoma samples, 1 out of 3 large cell carcinoma samples and in 1 out of 8 small cells carcinoma samples.

Primer pairs are also optionally and preferably encompassed within the present invention; for example, for the above experiment, the following primer pair was used as a non-limiting illustrative example only of a suitable primer pair: HSU40434 seg37-38F (SEQ ID NO:469) forward primer; and HSU40434 seg37-38R (SEQ ID NO:470) reverse primer.

The present invention also preferably encompasses any amplicon obtained through the use of any suitable primer pair; for example, for the above experiment, the following amplicon was obtained as a non-limiting illustrative example only of a suitable amplicon: HSU40434 seg37-38 (SEQ ID NO:471).

Primers:

```
Forward primer HSU40434 seg37-38F (SEQ ID NO: 469):
CCCCGAGGAGCTGAGCTC

Reverse primer HSU40434 seg37-38R (SEQ ID NO: 470):
CTGGGGACACGGTGGGTG
```

-continued

Amplicon HSU40434 seg37-38 (SEQ ID NO: 471):
CCCCGAGGAGCTGAGCTCCGTGCCCCCCAGCAGCATCTGGTGAGTCCCCAGAACTCTG

CCCGGCAAGGTGGGTCCGTGTGCTGGCGCTCACTGTCCACCCACCGTGTCCCCAG

Expression of *Homo sapiens* Mesothelin (MSLN) HSU40434 Transcripts which are Detectable by Amplicon as Depicted in Sequence Name HSU40434 seg37-38 (SEQ ID NO:471) in Normal and Cancerous Ovary Tissues:

Expression of *Homo sapiens* mesothelin (MSLN) transcripts detectable by or according to seg37-38—HSU40434 seg37-38 (SEQ ID NO:471) amplicon and primers HSU40434 seg37-38F (SEQ ID NO:469) and HSU40434 seg37-38R (SEQ ID NO:470) was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), SDHA (GenBank Accession No. NM_004168 (SEQ ID NO:462); amplicon—SDHA-amplicon (SEQ ID NO:465)), and GAPDH (GenBank Accession No. BC026907 (SEQ ID NO:438); GAPDH amplicon (SEQ ID NO:441) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45,46,48,71, Table 2_2, above), to obtain a value of fold up-regulation for each sample relative to median of the normal PM samples.

Figure 11:
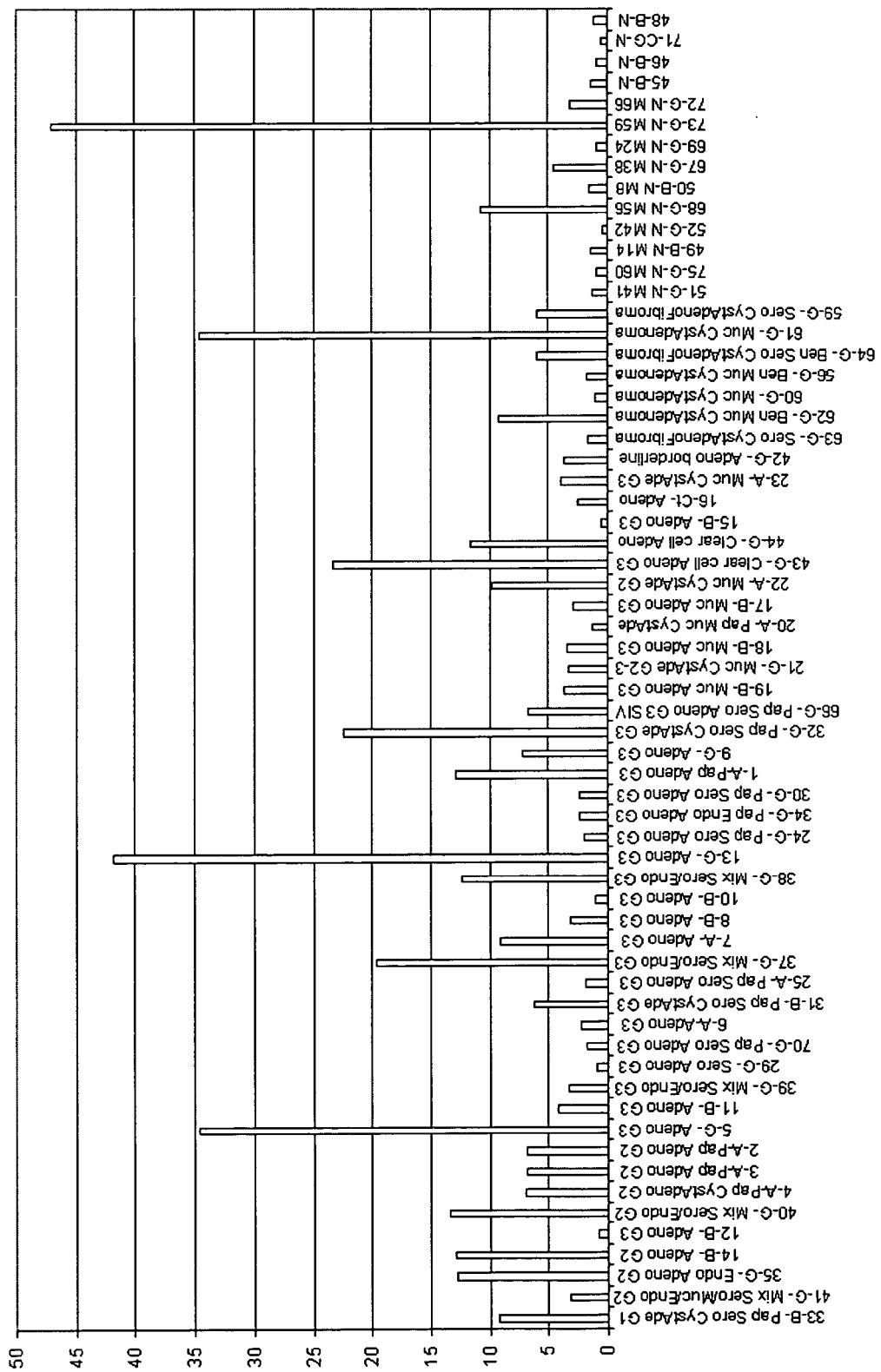
FIG. 11 is a histogram showing Expression of *Homo sapiens* mesothelin (MSLN) HSU40434 transcripts which are detectable by amplicon as depicted in sequence name HSU40434 seg37-38 (SEQ ID NO:471) in normal and cancerous ovarian tissues.

FIG. 11 is a histogram showing over expression of the above-indicated *Homo sapiens* mesothelin (MSLN) transcripts in cancerous Ovary samples relative to the normal samples.

As is evident from FIG. 11, the expression of *Homo sapiens* mesothelin (MSLN) transcripts detectable by the above amplicon in cancer samples was significantly higher than in the non-cancerous samples (Sample Nos. 45,46,48,71 Table 2_2,). Notably an over-expression of at least 5 fold was found in 20 out of 41 adenocarcinoma samples.

Statistical analysis was applied to verify the significance of these results, as described below.

The P value for the difference in the expression levels of *Homo sapiens* mesothelin (MSLN) transcripts detectable by the above amplicon in Ovary cancer samples versus the normal tissue samples was determined by T test as 4.2E-06. The above values demonstrate statistical significance of the results.

Primer pairs are also optionally and preferably encompassed within the present invention; for example, for the above experiment, the following primer pair was used as a non-limiting illustrative example only of a suitable primer pair: HSU40434 seg37-38 (SEQ ID NO:471) F forward primer; and HSU40434 seg37-38 (SEQ ID NO:471) R reverse primer.

The present invention also preferably encompasses any amplicon obtained through the use of any suitable primer pair; for example, for the above experiment, the following amplicon was obtained as a non-limiting illustrative example only of a suitable amplicon: HSU40434 seg37-38 (SEQ ID NO:471).

Primers:

Forward primer HSU40434 seg37-38F (SEQ ID NO: 469):
CCCCGAGGAGCTGAGCTC

Reverse primer HSU40434 seg37-38R (SEQ ID NO: 470):
CTGGGGACACGGTGGGTG

Amplicon HSU40434 seg37-38 (SEQ ID NO: 471):
CCCCGAGGAGCTGAGCTCCGTGCCCCCCAGCAGCATCTGGTGAGTCCCCAGAACTCTG

CCCGGCAAGGTGGGTCCGTGTGCTGGCGCTCACTGTCCACCCACCGTGTCCCCAG

The conversion of the HSU40434 seg37-38 (SEQ ID NO:471) name to the currently available sequence version, as listed in Table 43, is as follows: HSU40434 seg38-39.

Description for Cluster M62246

Cluster M62246 features 8 transcript(s) and 15 segment(s) of interest, the names for which are given in Tables 104 and 105, respectively, the sequences themselves are given at the end of the application. The selected protein variants are given in table 106.

TABLE 104

Transcripts of interest
Transcript Name

M62246_1_T4 (SEQ ID NO: 85)
M62246_1_T6 (SEQ ID NO: 86)
M62246_1_T8 (SEQ ID NO: 87)
M62246_1_T9 (SEQ ID NO: 88)
M62246_1_T12 (SEQ ID NO: 89)
M62246_1_T14 (SEQ ID NO: 90)
M62246_1_T15 (SEQ ID NO: 91)
M62246_1_T16 (SEQ ID NO: 92)

TABLE 105

Segments of interest
Segment Name

M62246_1_N2 (SEQ ID NO: 93)
M62246_1_N4 (SEQ ID NO: 94)
M62246_1_N5 (SEQ ID NO: 95)
M62246_1_N9 (SEQ ID NO: 96)
M62246_1_N11 (SEQ ID NO: 97)
M62246_1_N13 (SEQ ID NO: 98)
M62246_1_N17 (SEQ ID NO: 99)
M62246_1_N18 (SEQ ID NO: 100)

TABLE 105-continued

Segments of interest
Segment Name

M62246_1_N24 (SEQ ID NO: 101)
M62246_1_N26 (SEQ ID NO: 102)
M62246_1_N0 (SEQ ID NO: 103)
M62246_1_N7 (SEQ ID NO: 104)
M62246_1_N15 (SEQ ID NO: 105)
M62246_1_N20 (SEQ ID NO: 106)
M62246_1_N22 (SEQ ID NO: 107)

TABLE 106

Proteins of interest

| Protein Name | Corresponding Transcript(s) |
|---|---|
| M62246_1_P9 (SEQ ID NO: 111) | M62246_1_T12 (SEQ ID NO: 89); M62246_1_T15 (SEQ ID NO: 91); M62246_1_T16 (SEQ ID NO: 92); M62246_1_T4 (SEQ ID NO: 85); M62246_1_T6 (SEQ ID NO: 86) |
| M62246_1_P12 (SEQ ID NO: 112) | M62246_1_T8 (SEQ ID NO: 87) |
| M62246_1_P13 (SEQ ID NO: 113) | M62246_1_T9 (SEQ ID NO: 88) |
| M62246_1_P15 (SEQ ID NO: 114) | M62246_1_T14 (SEQ ID NO: 90) |

These sequences are variants of the known protein GPI-mannosyltransferase subunit (SEQ ID NO:108) (SwissProt accession identifier NP_060331), referred to herein as the previously known protein.

The sequence for protein GPI-mannosyltransferase subunit (SEQ ID NO:108) is given at the end of the application, as "GPI-mannosyltransferase subunit (SEQ ID NO:108) amino acid sequence".

Cluster M62246 can be used as a diagnostic marker according to overexpression of transcripts of this cluster in cancer. Expression of such transcripts in normal tissues is also given according to the previously described methods. The term "number" in the left hand column of the table and the numbers on the y-axis of the figure below refer to weighted expression of ESTs in each category, as "parts per million" (ratio of the expression of ESTs for a particular cluster to the expression of all ESTs in that category, according to parts per million).

Figure 12:
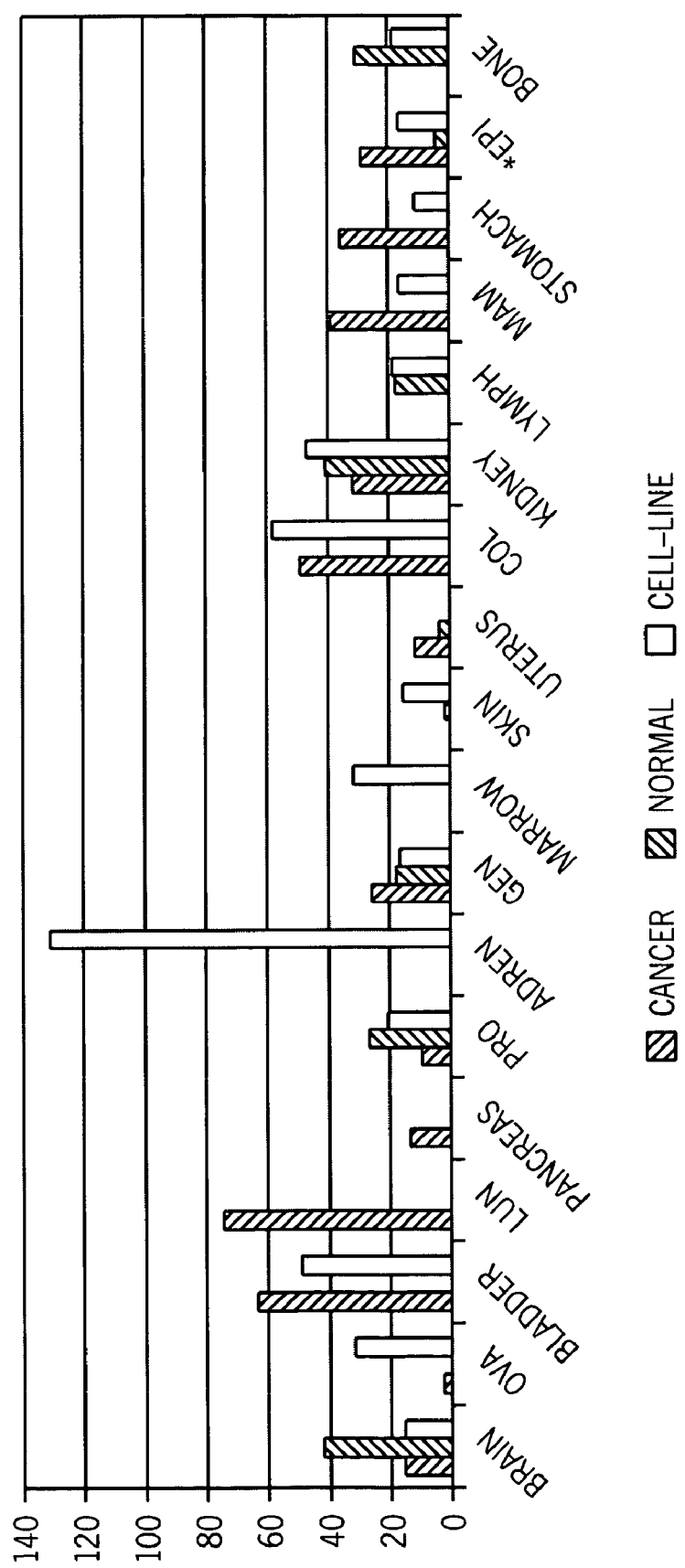
FIG. 12 is a histogram showing Cancer and cell-line vs. normal tissue expression for Cluster M62246, demonstrating overexpression in epithelial malignant tumors.

Overall, the following results were obtained as shown with regard to the histograms in FIG. 12 and Table 107. This cluster is overexpressed (at least at a minimum level) in the following pathological conditions: epithelial malignant tumors.

TABLE 107

Normal tissue distribution

| Name of Tissue | Number |
|---|---|
| brain | 42 |
| ovary | 0 |
| bladder | 0 |
| lung | 0 |
| pancreas | 0 |
| prostate | 27 |
| adrenal | 0 |
| general | 18 |
| bone marrow | 0 |
| skin | 2 |
| uterus | 4 |
| colon | 0 |

TABLE 107-continued

Normal tissue distribution

| Name of Tissue | Number |
|---|---|
| kidney | 41 |
| lymph nodes | 18 |
| breast | 0 |
| stomach | 0 |
| epithelial | 5 |
| bone | 31 |

TABLE 108

P values and ratios for expression in cancerous tissue

| Name of Tissue | P1 | P2 | SP1 | R3 | SP2 | R4 |
|---|---|---|---|---|---|---|
| brain | 5.2e-01 | 5.7e-01 | 9.8e-01 | 0.4 | 9.8e-01 | 0.4 |
| ovary | 6.2e-01 | 4.2e-01 | N/A | N/A | 7.7e-01 | 1.4 |
| bladder | 5.4e-01 | 3.4e-01 | 3.2e-01 | 2.5 | 3.2e-01 | 2.4 |
| lung | 9.8e-02 | 2.2e-01 | 1.1e-02 | 5.6 | 8.9e-02 | 3.0 |
| pancreas | 3.5e-01 | 4.5e-01 | 4.2e-01 | 2.4 | 5.3e-01 | 1.9 |
| prostate | 8.9e-01 | 8.8e-01 | 8.9e-01 | 0.6 | 8.4e-01 | 0.7 |
| adrenal | N/A | 4.3e-01 | N/A | N/A | 5.3e-01 | 1.9 |
| general | 2.0e-02 | 1.5e-02 | 9.3e-02 | 1.3 | 2.4e-01 | 1.1 |
| bone marrow | N/A | 7.1e-01 | N/A | N/A | 5.4e-01 | 1.9 |
| skin | 9.3e-01 | 4.9e-01 | N/A | N/A | 4.1e-01 | 1.8 |
| uterus | 4.5e-01 | 6.8e-01 | 6.6e-01 | 1.3 | 8.0e-01 | 1.1 |
| colon | 1.9e-02 | 1.2e-02 | 3.4e-01 | 2.6 | 2.7e-01 | 2.7 |
| kidney | 8.7e-01 | 8.4e-01 | 6.1e-01 | 0.9 | 5.2e-01 | 0.9 |
| lymph nodes | 8.6e-01 | 8.8e-01 | 1.0e+00 | 0.5 | 8.2e-01 | 0.9 |
| breast | 3.4e-01 | 3.1e-01 | 4.7e-01 | 1.9 | 5.6e-01 | 1.7 |
| stomach | 2.7e-01 | 3.9e-01 | 5.0e-01 | 2.0 | 6.3e-01 | 1.5 |
| epithelial | 1.8e-03 | 1.4e-03 | 3.8e-04 | 3.8 | 1.2e-03 | 3.2 |
| bone | 9.2e-01 | 8.7e-01 | 1.0e+00 | 0.5 | 9.1e-01 | 0.7 |

As noted above, cluster M62246 features 8 transcript(s), which were listed in Table 104 above. These transcript(s) encode for protein(s) which are variant(s) of protein GPI-mannosyltransferase subunit (SEQ ID NO:108). A description of each variant protein according to the present invention is now provided.

Variant protein M62246_1_P9 (SEQ ID NO:111) according to the present invention has an amino acid sequence as given at the end of the application; it is encoded by transcript(s) M62246_1_T12 (SEQ ID NO:89), M62246_1_T15 (SEQ ID NO:91), M62246_1_T16 (SEQ ID NO:92), M62246_1_T4 (SEQ ID NO:85) and M62246_T6 (SEQ ID NO:86). An alignment is given to the known protein (GPI-mannosyltransferase subunit (SEQ ID NO:108)) at the end of the application. One or more alignments to one or more previously published protein sequences are given at the end of the application. A brief description of the relationship of the variant protein according to the present invention to each such aligned protein is as follows:

1. Comparison Report Between M62246_1_P9 (SEQ ID NO:111) and NP_060331:

A. An isolated chimeric polypeptide encoding for M62246_1_P9 (SEQ ID NO:111), comprising a first amino acid sequence being at least 90% homologous to MVSENFDIEAPNYLSKESEVLIYARRDSQCID-CFQAFLPVHCRYHRPHSEDGEASIVVNNP DLLM-FCDQEFPILKCWAHSEVAAPCAL corresponding to amino acids 68-155 of NP_060331, which also corresponds to amino acids 1-88 of M62246_1_P9 (SEQ ID NO:111), a bridging amino acid E corresponding to amino acid 89 of M62246_1_P9 (SEQ ID NO:111), and a second amino acid sequence being at least 90% homologous to NEDICQWNK- MKYKSVYKNVILQVPVGLTVHTSLVCS-VTLLITILCSTLILVAVFKYGHFSL corresponding to amino acids 157-217 of NP_060331, which also corresponds to amino acids 90-150 of M62246_1_P9 (SEQ ID NO:111), wherein said, first amino acid sequence, bridging amino acid and second amino acid sequence are contiguous and in a sequential order.

2. Comparison Report Between M62246_1_P9 (SEQ ID NO:111) and Q8TBF5_HUMAN (SEQ ID NO:109):

A. An isolated chimeric polypeptide encoding for M62246_1_P9 (SEQ ID NO:111), comprising a first amino acid sequence being at least 90% homologous to MVSEN-FDIEAPNYLSKESEVLIYARRDSQCID-CFQAFLPVHCRYHRPHSEDGEASIVVNNP DLLM-FCDQEFPILKCWAHSEVAAPCAL corresponding to amino acids 68-155 of Q8TBF5_HUMAN (SEQ ID NO:109), which also corresponds to amino acids 1-88 of M62246_1_P9 (SEQ ID NO:111), a bridging amino acid E corresponding to amino acid 89 of M62246_1_P9 (SEQ ID NO:111), and a second amino acid sequence being at least 90% homologous to NEDICQWNKMKYKSVYKN-VILQVPVGLTVHTSLVCSVTLLI-TILCSTLILVAVFKYGHFSL corresponding to amino acids 157-217 of Q8TBF5_HUMAN (SEQ ID NO:109), which also corresponds to amino acids 90-150 of M62246_1_P9 (SEQ ID NO:111), wherein said, first amino acid sequence, bridging amino acid and second amino acid sequence are contiguous and in a sequential order.

3. Comparison Report Between M62246_1_P9 (SEQ ID NO:111) and Q9NWZ2_HUMAN (SEQ ID NO:110):

A. An isolated chimeric polypeptide encoding for M62246_1_P9 (SEQ ID NO:111), comprising a first amino acid sequence being at least 90% homologous to MVSEN-FDIEAPNYLSKESEVLIYARRDSQCID-CFQAFLPVHCRYHRPHSEDGEASIVVNNP DLLM-FCDQ corresponding to amino acids 68-136 of Q9NWZ2_HUMAN (SEQ ID NO:110), which also corresponds to amino acids 1-69 of M62246_1_P9 (SEQ ID NO:111), a second amino acid sequence being at least 90% homologous to EFPILKCWAHSEVAAPCALENEDIC-QWNKMKYKSVYKNVILQVPVGLTVHTSLVCSVTL LITILCS corresponding to amino acids 155-220 of Q9NWZ2_HUMAN (SEQ ID NO:110), which also corresponds to amino acids 70-135 of M62246_1_P9 (SEQ ID NO:111), and a third amino acid sequence being at least 70%, optionally at least 80%, preferably at least 85%, more preferably at least 90% and most preferably at least 95% homologous to a polypeptide having the sequence TLIL-VAVFKYGHFSL (SEQ ID NO:546) corresponding to amino acids 136-150 of M62246_1_P9 (SEQ ID NO:111), wherein said, first amino acid sequence, second amino acid sequence and third amino acid sequence are contiguous and in a sequential order.

C. An isolated chimeric polypeptide encoding for an edge portion of M62246_1_P9 (SEQ ID NO:111), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QE, having a structure as follows: a sequence starting from any of amino acid numbers 69-x to 69; and ending at any of amino acid numbers 70+((n−2)−x), in which x varies from 0 to n−2.

D. An isolated polypeptide encoding for an edge portion of M62246_1_P9 (SEQ ID NO:111), comprising an amino acid sequence being at least 70%, optionally at least about 80%, preferably at least about 85%, more preferably at least about 90% and most preferably at least about 95% homologous to the sequence TLILVAVFKYGHFSL (SEQ ID NO:546) of M62246_1_P9 (SEQ ID NO:111).

The localization of the variant protein was determined according to results from a number of different software programs and analyses, including analyses from SignalP and other specialized programs. The variant protein is believed to be located as follows with regard to the cell: membrane.

Variant protein M62246_1_P9 (SEQ ID NO:111) also has the following non-silent SNPs (Single Nucleotide Polymorphisms) as listed in Table 109, (given according to their position(s) on the amino acid sequence, with the alternative amino acid(s) listed; the last column indicates whether the SNP is known or not; the presence of known SNPs in variant protein M62246_1_P9 (SEQ ID NO:111) sequence provides support for the deduced sequence of this variant protein according to the present invention).

TABLE 109

Amino acid mutations

| SNP position(s) on amino acid sequence | Alternative amino acid(s) | Previously known SNP? |
|---|---|---|
| 47 | P -> L | Yes |
| 89 | E -> D | No |

Variant protein M62246_1_P9 (SEQ ID NO:111) is encoded by the following transcript(s): M62246_1_T12 (SEQ ID NO:89), M62246_1_T15 (SEQ ID NO:91), M62246_1_T16 (SEQ ID NO:92), M62246_1_T4 (SEQ ID NO:85) and M62246_1_T6 (SEQ ID NO:86), for which the sequence(s) is/are given at the end of the application.

The coding portion of transcript M62246_1_T12 (SEQ ID NO:89) is shown in bold; this coding portion starts at position 705 and ends at position 1154. The transcript also has the following SNPs as listed in Table 110 (given according to their position on the nucleotide sequence, with the alternative nucleic acid listed; the last column indicates whether the SNP is known or not; the presence of known SNPs in variant protein M62246_1_P9 (SEQ ID NO:111) sequence provides support for the deduced sequence of this variant protein according to the present invention).

TABLE 110

Nucleic acid SNPs

| SNP position(s) on nucleotide sequence | Alternative nucleic acid(s) | Previously known SNP? |
|---|---|---|
| 60 | G -> A | Yes |
| 260 | C -> G | No |
| 432 | C -> T | Yes |
| 608 | C -> G | No |
| 844 | C -> T | Yes |
| 971 | G -> T | No |
| 1064 | C -> T | No |
| 1553 | A -> G | Yes |
| 1618 | A -> G | No |
| 1774 | C -> T | Yes |
| 1786 | C -> A | Yes |
| 1858 | A -> C | Yes |

The coding portion of transcript M62246_1_T15 (SEQ ID NO:91) is shown in bold; this coding portion starts at position 1151 and ends at position 1600. The transcript also has the following SNPs as listed in Table 111 (given according to their position on the nucleotide sequence, with the alternative nucleic acid listed; the last column indicates whether the SNP is known or not; the presence of known SNPs in variant protein M62246_1_P9 (SEQ ID NO:111) sequence provides support for the deduced sequence of this variant protein according to the present invention).

TABLE 111

| SNP position(s) on nucleotide sequence | Nucleic acid SNPs Alternative nucleic acid(s) | Previously known SNP? |
|---|---|---|
| 60 | G -> A | Yes |
| 260 | C -> G | No |
| 422 | G -> A | Yes |
| 445 | C -> T | Yes |
| 692 | G -> A | Yes |
| 1054 | C -> G | No |
| 1290 | C -> T | Yes |
| 1417 | G -> T | No |
| 1510 | C -> T | No |
| 1999 | A -> G | Yes |
| 2064 | A -> G | No |
| 2220 | C -> T | Yes |
| 2232 | C -> A | Yes |
| 2304 | A -> C | Yes |

The coding portion of transcript M62246_1_T16 (SEQ ID NO:92) is shown in bold; this coding portion starts at position 371 and ends at position 820. The transcript also has the following SNPs as listed in Table 112 (given according to their position on the nucleotide sequence, with the alternative nucleic acid listed; the last column indicates whether the SNP is known or not; the presence of known SNPs in variant protein M62246_1_P9 (SEQ ID NO:111) sequence provides support for the deduced sequence of this variant protein according to the present invention).

TABLE 112

| SNP position(s) on nucleotide sequence | Nucleic acid SNPs Alternative nucleic acid(s) | Previously known SNP? |
|---|---|---|
| 54 | C -> T | Yes |
| 274 | C -> G | No |
| 510 | C -> T | Yes |
| 637 | G -> T | No |
| 730 | C -> T | No |
| 1219 | A -> G | Yes |
| 1284 | A -> G | No |
| 1440 | C -> T | Yes |
| 1452 | C -> A | Yes |
| 1524 | A -> C | Yes |

The coding portion of transcript M62246_1_T4 (SEQ ID NO:85) is shown in bold; this coding portion starts at position 642 and ends at position 1091. The transcript also has the following SNPs as listed in Table 113 (given according to their position on the nucleotide sequence, with the alternative nucleic acid listed; the last column indicates whether the SNP is known or not; the presence of known SNPs in variant protein M62246_1_P9 (SEQ ID NO:111) sequence provides support for the deduced sequence of this variant protein according to the present invention).

TABLE 113

| SNP position(s) on nucleotide sequence | Nucleic acid SNPs Alternative nucleic acid(s) | Previously known SNP? |
|---|---|---|
| 60 | G -> A | Yes |
| 260 | C -> G | No |
| 428 | C -> G | No |
| 781 | C -> T | Yes |
| 908 | G -> T | No |
| 1001 | C -> T | No |
| 1490 | A -> G | Yes |
| 1555 | A -> G | No |
| 1711 | C -> T | Yes |
| 1723 | C -> A | Yes |
| 1795 | A -> C | Yes |

The coding portion of transcript M62246_1_T6 (SEQ ID NO:86) is shown in bold; this coding portion starts at position 642 and ends at position 1091. The transcript also has the following SNPs as listed in Table 114 (given according to their position on the nucleotide sequence, with the alternative nucleic acid listed; the last column indicates whether the SNP is known or not; the presence of known SNPs in variant protein M62246_1_P9 (SEQ ID NO:111) sequence provides support for the deduced sequence of this variant protein according to the present invention).

TABLE 114

| SNP position(s) on nucleotide sequence | Nucleic acid SNPs Alternative nucleic acid(s) | Previously known SNP? |
|---|---|---|
| 60 | G -> A | Yes |
| 260 | C -> G | No |
| 428 | C -> G | No |
| 781 | C -> T | Yes |
| 908 | G -> T | No |
| 1001 | C -> T | No |

Variant protein M62246_1_P12 (SEQ ID NO:112) according to the present invention has an amino acid sequence as given at the end of the application; it is encoded by transcript(s) M62246_1_T8 (SEQ ID NO:87). An alignment is given to the known protein (GPI-mannosyltransferase subunit (SEQ ID NO:108)) at the end of the application. One or more alignments to one or more previously published protein sequences are given at the end of the application. A brief description of the relationship of the variant protein according to the present invention to each such aligned protein is as follows:

1. Comparison Report Between M62246_1_P12 (SEQ ID NO:112) and Q9NWZ2_HUMAN (SEQ ID NO:110):

A. An isolated chimeric polypeptide encoding for M62246_1_P12 (SEQ ID NO:112), comprising a first amino acid sequence being at least 90% homologous to MCSEIIL-RQEVLKDGFHRDLLIKVKFGESIEDLHT-CRLLIKQDIPAGLYVDPYELASLRERNI TEAVMVSEN-FDIEAPNYLSKESEVLIYARRDSQCIDCFQAFLPVHCR YHRPHSEDGEASIV VNNPDLLMFCDQAGSRRMIR-FRFDSFDKTIEFPILKCWAHSEVAAP-CALENEDICQWNKM KYKSVYKN-VILQVPVGLTVHTSLVCSVTLLITILCS corresponding to amino acids 1-220 of Q9NWZ2_HUMAN (SEQ ID NO:110), which also corresponds to amino acids 1-220 of M62246_1_P12 (SEQ ID NO:112), and a second amino acid sequence being at least 70%, optionally at least 80%, preferably at least 85%, more preferably at least 90% and most preferably at least 95% homologous to a polypeptide having the sequence TLILVAVFKYGHFSL (SEQ ID NO:546) corresponding to amino acids 221-235 of M62246_1_P12 (SEQ ID NO:112), wherein said first amino acid sequence and second amino acid sequence are contiguous and in a sequential order.

B. An isolated polypeptide encoding for an edge portion of M62246_1_P12 (SEQ ID NO:1 12), comprising an amino acid sequence being at least 70%, optionally at least about 80%, preferably at least about 85%, more preferably at least about 90% and most preferably at least about 95% homologous to the sequence TLILVAVFKYGHFSL (SEQ ID NO:546) of M62246_1_P12 (SEQ ID NO:112).

2. Comparison Report Between M62246_1_P12 (SEQ ID NO:112) and NP_060331:

A. An isolated chimeric polypeptide encoding for M62246_1_P12 (SEQ ID NO:112), comprising a first amino acid sequence being at least 90% homologous to MCSEIIL-RQEVLKDGFHRDLLIKVKFGESIEDLHT-CRLLIKQDIPAGLYVDPYELASLRERNI TEAVMVSEN-FDIEAPNYLSKESEVLIYARRDSQCIDCFQAFLPVHCR YHRPHSEDGEASIV VNNPDLLMFCDQ corresponding to amino acids 1-136 of NP_060331, which also corresponds to amino acids 1-136 of M62246_1_P12 (SEQ ID NO:112), a second amino acid sequence being at least 70%, optionally at least 80%, preferably at least 85%, more preferably at least 90% and most preferably at least 95% homologous to a polypeptide having the sequence AGSRRMIRFRFDSFD-KTI (SEQ ID NO:548) corresponding to amino acids 137-154 of M62246_1_P12 (SEQ ID NO:1 12), a third amino acid sequence being at least 90% homologous to EFPILKCWAHSEVAAPCAL corresponding to amino acids 137-155 of NP_060331, which also corresponds to amino acids 155-173 of M62246_1_P12 (SEQ ID NO:112), a bridging amino acid E corresponding to amino acid 174 of M62246_1_P12 (SEQ ID NO:112), and a fourth amino acid sequence being at least 90% homologous to NEDICQWNK-MKYKSVYKNVILQVPVGLTVHTSLVCS-VTLLITILCSTLILVAVFKYGHFSL corresponding to amino acids 157-217 of NP_060331, which also corresponds to amino acids 175-235 of M62246_1_P12 (SEQ ID NO:112), wherein said first amino acid sequence, second amino acid sequence, third amino acid sequence, bridging amino acid and fourth amino acid sequence are contiguous and in a sequential order.

B. An isolated polypeptide encoding for an edge portion of M62246_1_P12 (SEQ ID NO:112), comprising an amino acid sequence being at least 70%, optionally at least about 80%, preferably at least about 85%, more preferably at least about 90% and most preferably at least about 95% homologous to the sequence AGSRRMIRFRFDSFDKTI (SEQ ID NO:548) of M62246_1_P12(SEQIDNO:112).

3. Comparison Report Between M62246_1_P12 (SEQ ID NO:112) and Q8TBF5_HUMAN (SEQ ID NO:109):

A. An isolated chimeric polypeptide encoding for M62246_1_P12 (SEQ ID NO:112), comprising a first amino acid sequence being at least 90% homologous to MCSEIIL-RQEVLKDGFHRDLLIKVKFGESIEDLHT-CRLLIKQDIPAGLYVDPYELASLRERNI TEAVMVSEN-FDIEAPNYLSKESEVLIYARRDSQCIDCFQAFLPVHCR YHRPHSEDGEASIV VNNPDLLMFCDQ corresponding to amino acids 1-136 of Q8TBF5_HUMAN (SEQ ID NO:109), which also corresponds to amino acids 1-136 of M62246_1_P12 (SEQ ID NO:112), a second amino acid sequence being at least 70%, optionally at least 80%, preferably at least 85%, more preferably at least 90% and most preferably at least 95% homologous to a polypeptide having the sequence AGSRRMIRFRFDSFDKTI (SEQ ID NO:548) corresponding to amino acids 137-154 of M62246_1_P12 (SEQ ID NO:1 12), a third amino acid sequence being at least 90% homologous to EFPILKCWAHSEVAAPCAL corresponding to amino acids 137-155 of Q8TBF5_HUMAN (SEQ ID NO:109), which also corresponds to amino acids 155-173 of M62246_1_P12 (SEQ ID NO:1 12), a bridging amino acid E corresponding to amino acid 174 of M62246_1_P12 (SEQ ID NO:112), and a fourth amino acid sequence being at least 90% homologous to NEDICQWNKMKYKS-VYKNVILQVPVGLTVHTSLVCSVTLLI-TILCSTLILVAVFKYGHFSL corresponding to amino acids 157-217 of Q8TBF5_HUMAN (SEQ ID NO:109), which also corresponds to amino acids 175-235 of M62246_1_P12 (SEQ ID NO:112), wherein said first amino acid sequence, second amino acid sequence, third amino acid sequence, bridging amino acid and fourth amino acid sequence are contiguous and in a sequential order.

B. An isolated polypeptide encoding for an edge portion of M62246_1_P12 (SEQ ID NO:112), comprising an amino acid sequence being at least 70%, optionally at least about 80%, preferably at least about 85%, more preferably at least about 90% and most preferably at least about 95% homologous to the sequence AGSRRMIRFRFDSFDKTI (SEQ ID NO:548) of M62246_1_P12 (SEQ ID NO:112).

The localization of the variant protein was determined according to results from a number of different software programs and analyses, including analyses from SignalP and other specialized programs. The variant protein is believed to be located as follows with regard to the cell: membrane.

Variant protein M62246_1_P12 (SEQ ID NO:112) also has the following non-silent SNPs (Single Nucleotide Polymorphisms) as listed in Table 115, (given according to their position(s) on the amino acid sequence, with the alternative amino acid(s) listed; the last column indicates whether the SNP is known or not; the presence of known SNPs in variant protein M62246_1_P12 (SEQ ID NO:112) sequence provides support for the deduced sequence of this variant protein according to the present invention).

TABLE 115

Amino acid mutations

| SNP position(s) on amino acid sequence | Alternative amino acid(s) | Previously known SNP? |
|---|---|---|
| 114 | P -> L | Yes |
| 174 | E -> D | No |

Variant protein M62246_1_P12 (SEQ ID NO:112) is encoded by the following transcript(s): M62246_1_T8 (SEQ ID NO:87), for which the sequence(s) is/are given at the end of the application. The coding portion of transcript M62246_1_T8 (SEQ ID NO:87) is shown in bold; this coding portion starts at position 324 and ends at position 1028. The transcript also has the following SNPs as listed in Table 116 (given according to their position on the nucleotide sequence, with the alternative nucleic acid listed; the last column indicates whether the SNP is known or not; the presence of known SNPs in variant protein M62246_1_P12 (SEQ ID NO:112) sequence provides support for the deduced sequence of this variant protein according to the present invention).

TABLE 116

Nucleic acid SNPs

| SNP position(s) on nucleotide sequence | Alternative nucleic acid(s) | Previously known SNP? |
|---|---|---|
| 60 | G -> A | Yes |
| 260 | C -> G | No |
| 428 | C -> G | No |
| 664 | C -> T | Yes |
| 845 | G -> T | No |
| 938 | C -> T | No |
| 1427 | A -> G | Yes |
| 1492 | A -> G | No |
| 1648 | C -> T | Yes |
| 1660 | C -> A | Yes |
| 1732 | A -> C | Yes |

Variant protein M62246_1_P13 (SEQ ID NO:113) according to the present invention has an amino acid sequence as given at the end of the application; it is encoded by transcript(s) M62246_1_T9 (SEQ ID NO:88). An alignment is given to the known protein (GPI-mannosyltransferase subunit (SEQ ID NO:108)) at the end of the application. One or more alignments to one or more previously published protein sequences are given at the end of the application. A brief description of the relationship of the variant protein according to the present invention to each such aligned protein is as follows:

1. Comparison Report Between M62246_1_P13 (SEQ ID NO:113) and NP_060331:

A. An isolated chimeric polypeptide encoding for M62246_1_P13 (SEQ ID NO:113), comprising a first amino acid sequence being at least 90% homologous to MCSEIIL-RQEVLKDGFHRDLLIKVKFGESIEDLHT-CRLLIKQDIPAGLYVDPYELASLRERNI TEAVMVSEN-FDIEAPNYLSKESEVLIYARRDSQCIDCFQAFLPVHCR YHRPHSEDGEASIV VNNPDLLMFCDQEFPILKCWAH-SEVAAPCAL corresponding to amino acids 1-155 of NP_060331, which also corresponds to amino acids 1-155 of M62246_1_P13 (SEQ ID NO:113), a bridging amino acid E corresponding to amino acid 156 of M62246_1_P13 (SEQ ID NO:113), a second amino acid sequence being at least 90% homologous to NEDICQWNKMKYKS corresponding to amino acids 157-170 of NP_060331, which also corresponds to amino acids 157-170 of M62246_1_P13 (SEQ ID NO:113), and a third amino acid sequence being at least 70%, optionally at least 80%, preferably at least 85%, more preferably at least 90% and most preferably at least 95% homologous to a polypeptide having the sequence TGFHRISQDG-LDLLTS (SEQ ID NO:549) corresponding to amino acids 171-186 of M62246_1_P13 (SEQ ID NO:113), wherein said first amino acid sequence, bridging amino acid, second amino acid sequence and third amino acid sequence are contiguous and in a sequential order.

B. An isolated polypeptide encoding for an edge portion of M62246_1_P13 (SEQ ID NO:113), comprising an amino acid sequence being at least 70%, optionally at least about 80%, preferably at least about 85%, more preferably at least about 90% and most preferably at least about 95% homologous to the sequence TGFHRISQDGLDLLTS (SEQ ID NO:549) of M62246_1_P13 (SEQ ID NO:113).

2. Comparison Report Between M62246_1_P13 (SEQ ID NO:113) and Q8TBF5_HUMAN (SEQ ID NO:109):

A. An isolated chimeric polypeptide encoding for M62246_1_P13 (SEQ ID NO:113), comprising a first amino acid sequence being at least 90% homologous to MCSEIIL-RQEVLKDGFHRDLLIKVKFGESIEDLHT-CRLLIKQDIPAGLYVDPYELASLRERNI TEAVMVSEN-FDIEAPNYLSKESEVLIYARRDSQCIDCFQAFLPVHCR YHRPHSEDGEASIV VNNPDLLMFCDQEFPILKCWAH-SEVAAPCAL corresponding to amino acids 1-155 of Q8TBF5_HUMAN (SEQ ID NO:109), which also corresponds to amino acids 1-155 of M62246_1_P13 (SEQ ID NO:113), a bridging amino acid E corresponding to amino acid 156 of M62246_1_P13 (SEQ ID NO:113), a second amino acid sequence being at least 90% homologous to NEDICQWNKMKYKS corresponding to amino acids 157-170 of Q8TBF5_HUMAN (SEQ ID NO:109), which also corresponds to amino acids 157-170 of M62246_1_P13 (SEQ ID NO:113), and a third amino acid sequence being at least 70%, optionally at least 80%, preferably at least 85%, more preferably at least 90% and most preferably at least 95% homologous to a polypeptide having the sequence TGF-HRISQDGLDLLTS (SEQ ID NO:549) corresponding to amino acids 171-186 of M62246_1_P13 (SEQ ID NO:113), wherein said first amino acid sequence, bridging amino acid, second amino acid sequence and third amino acid sequence are contiguous and in a sequential order.

B. An isolated polypeptide encoding for an edge portion of M62246_1_P13 (SEQ ID NO:113), comprising an amino acid sequence being at least 70%, optionally at least about 80%, preferably at least about 85%, more preferably at least about 90% and most preferably at least about 95% homologous to the sequence TGFHRISQDGLDLLTS (SEQ ID NO:549) of M62246_1_P13 (SEQ ID NO:113).

3. Comparison Report Between M62246_1_P13 (SEQ ID NO:113) and Q9NWZ2_HUMAN (SEQ ID NO:110):

A. An isolated chimeric polypeptide encoding for M62246_1_P13 (SEQ ID NO:113), comprising a first amino acid sequence being at least 90% homologous to MCSEIIL-RQEVLKDGFHRDLLIKVKFGESIEDLHT-CRLLIKQDIPAGLYVDPYELASLRERNI TEAVMVSEN-FDIEAPNYLSKESEVLIYARRDSQCIDCFQAFLPVHCR YHRPHSEDGEASIV VNNPDLLMFCDQ corresponding to amino acids 1-136 of Q9NWZ2_HUMAN (SEQ ID NO:110), which also corresponds to amino acids 1-136 of M62246_1_P13 (SEQ ID NO:113), a second amino acid sequence being at least 90% homologous to EFPILKCWAH-SEVAAPCALENEDICQWNKMKYKS corresponding to amino acids 155-188 of Q9NWZ2_HUMAN (SEQ ID NO:110), which also corresponds to amino acids 137-170 of M62246_1_P13 (SEQ ID NO:113), and a third amino acid sequence being at least 70%, optionally at least 80%, preferably at least 85%, more preferably at least 90% and most preferably at least 95% homologous to a polypeptide having the sequence TGFHRISQDGLDLLTS (SEQ ID NO:549) corresponding to amino acids 171-186 of M62246_1_P13 (SEQ ID NO:113), wherein said first amino acid sequence, second amino acid sequence and third amino acid sequence are contiguous and in a sequential order.

B. An isolated chimeric polypeptide encoding for an edge portion of M62246_1_P13 (SEQ ID NO:113), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise QE, having a structure as follows: a sequence starting from any of amino acid numbers 136-x to 136; and ending at any of amino acid numbers 137+((n−2)−x), in which x varies from 0 to n−2.

C. An isolated polypeptide encoding for an edge portion of M62246_1_P13 (SEQ ID NO:113), comprising an amino acid sequence being at least 70%, optionally at least about 80%, preferably at least about 85%, more preferably at least about 90% and most preferably at least about 95% homologous to the sequence TGFHRISQDGLDLLTS (SEQ ID NO:549) of M62246_1_P13 (SEQ ID NO:113).

The localization of the variant protein was determined according to results from a number of different software programs and analyses, including analyses from SignalP and other specialized programs. The variant protein is believed to be located as follows with regard to the cell: intra cellularly.

Variant protein M62246_1_P13 (SEQ ID NO:113) also has the following non-silent SNPs (Single Nucleotide Polymorphisms) as listed in Table 117, (given according to their position(s) on the amino acid sequence, with the alternative amino acid(s) listed; the last column indicates whether the SNP is known or not; the presence of known SNPs in variant protein M62246_1_P13 (SEQ ID NO:113) sequence provides support for the deduced sequence of this variant protein according to the present invention).

TABLE 117

Amino acid mutations

| SNP position(s) on amino acid sequence | Alternative amino acid(s) | Previously known SNP? |
|---|---|---|
| 114 | P -> L | Yes |
| 156 | E -> D | No |

Variant protein M62246_1_P13 (SEQ ID NO:113) is encoded by the following transcript(s): M62246_1_T9 (SEQ ID NO:88), for which the sequence(s) is/are given at the end of the application. The coding portion of transcript M62246_1_T9 (SEQ ID NO:88) is shown in bold; this coding portion starts at position 324 and ends at position 881. The transcript also has the following SNPs as listed in Table 118 (given according to their position on the nucleotide sequence, with the alternative nucleic acid listed; the last column indicates whether the SNP is known or not; the presence of known SNPs in variant protein M62246_1_P13 (SEQ ID NO:113) sequence provides support for the deduced sequence of this variant protein according to the present invention).

TABLE 118

Nucleic acid SNPs

| SNP position(s) on nucleotide sequence | Alternative nucleic acid(s) | Previously known SNP? |
|---|---|---|
| 60 | G -> A | Yes |
| 260 | C -> G | No |
| 428 | C -> G | No |
| 664 | C -> T | Yes |
| 791 | G -> T | No |
| 1011 | G -> A | Yes |
| 1142 | G -> C | Yes |
| 1336 | T -> C | Yes |
| 1350 | C -> A | Yes |

Variant protein M62246_1_P15 (SEQ ID NO:114) according to the present invention has an amino acid sequence as given at the end of the application; it is encoded by transcript(s) M62246_1_T14 (SEQ ID NO:90).

The localization of the variant protein was determined according to results from a number of different software programs and analyses, including analyses from SignalP and other specialized programs. The variant protein is believed to be located as follows with regard to the cell: intracellularly.

Variant protein M62246_1_P15 (SEQ ID NO:114) is encoded by the following transcript(s): M62246_1_T14 (SEQ ID NO:90), for which the sequence(s) is/are given at the end of the application. The coding portion of transcript M62246_1_T14 (SEQ ID NO:90) is shown in bold; this coding portion starts at position 324 and ends at position 560. The transcript also has the following SNPs as listed in Table 119 (given according to their position on the nucleotide sequence, with the alternative nucleic acid listed; the last column indicates whether the SNP is known or not; the presence of known SNPs in variant protein M62246_1_P15 (SEQ ID NO:114) sequence provides support for the deduced sequence of this variant protein according to the present invention).

TABLE 119

Nucleic acid SNPs

| SNP position(s) on nucleotide sequence | Alternative nucleic acid(s) | Previously known SNP? |
|---|---|---|
| 60 | G -> A | Yes |
| 260 | C -> G | No |
| 428 | C -> G | No |
| 781 | C -> T | Yes |

As noted above, cluster M62246 features 15 segment(s), which were listed in Table 105 above and for which the sequence(s) are given at the end of the application. These segment(s) are portions of nucleic acid sequence(s) which are described herein separately because they are of particular interest. A description of each segment according to the present invention is now provided.

Segment cluster M62246_1_N2 (SEQ ID NO:93) according to the present invention is supported by 3 libraries. The number of libraries was determined as previously described. This segment can be found in the following transcript(s): M62246_1_T16 (SEQ ID NO:92). Table 120 below describes the starting and ending position of this segment on each transcript.

TABLE 120

Segment location on transcripts

| Transcript name | Segment starting position | Segment ending position |
|---|---|---|
| M62246_1_T16 (SEQ ID NO: 92) | 102 | 222 |

Segment cluster M62246_1_N4 (SEQ ID NO:94) according to the present invention is supported by 35 libraries. The number of libraries was determined as previously described. This segment can be found in the following transcript(s): M62246_1_T12 (SEQ ID NO:89), M62246_1_T14 (SEQ ID NO:90), M62246_1_T15 (SEQ ID NO:91), M62246₁_T4 (SEQ ID NO:85), M622461_T6 (SEQ ID NO:86), M622461_T8 (SEQ ID NO:87) and M62246_1_T9 (SEQ ID NO:88). Table 121 below describes the starting and ending position of this segment on each transcript.

TABLE 121

Segment location on transcripts

| Transcript name | Segment starting position | Segment ending position |
|---|---|---|
| M62246_1_T12 (SEQ ID NO: 89) | 1 | 312 |
| M62246_1_T14 (SEQ ID NO: 90) | 1 | 312 |
| M62246_1_T15 (SEQ ID NO: 91) | 1 | 312 |
| M62246_1_T4 (SEQ ID NO: 85) | 1 | 312 |
| M62246_1_T6 (SEQ ID NO: 86) | 1 | 312 |
| M62246_1_T8 (SEQ ID NO: 87) | 1 | 312 |
| M62246_1_T9 (SEQ ID NO: 88) | 1 | 312 |

Segment cluster M62246_1_N5 (SEQ ID NO:95) according to the present invention is supported by 6 libraries. The number of libraries was determined as previously described. This segment can be found in the following transcript(s): M62246_1_T15 (SEQ ID NO:91). Table 122 below describes the starting and ending position of this segment on each transcript.

TABLE 122

Segment location on transcripts

| Transcript name | Segment starting position | Segment ending position |
|---|---|---|
| M62246_1_T15 (SEQ ID NO: 91) | 313 | 792 |

Segment cluster M62246_1_N9 (SEQ ID NO:96) according to the present invention is supported by 1 libraries. The number of libraries was determined as previously described. This segment can be found in the following transcript(s): M62246_1_T15 (SEQ ID NO:91). Table 123 below describes the starting and ending position of this segment on each transcript.

TABLE 123

Segment location on transcripts

| Transcript name | Segment starting position | Segment ending position |
|---|---|---|
| M62246_1_T15 (SEQ ID NO: 91) | 857 | 1002 |

Segment cluster M62246_1_N11 (SEQ ID NO:97) according to the present invention is supported by 5 libraries. The number of libraries was determined as previously described. This segment can be found in the following transcript(s): M62246_1_T12 (SEQ ID NO:89). Table 124 below describes the starting and ending position of this segment on each transcript.

TABLE 124

Segment location on transcripts

| Transcript name | Segment starting position | Segment ending position |
|---|---|---|
| M62246_1_T12 (SEQ ID NO: 89) | 377 | 556 |

Segment cluster M62246_1_N13 (SEQ ID NO:98) according to the present invention is supported by 52 libraries. The number of libraries was determined as previously described. This segment can be found in the following transcript(s): M62246_1_T12 (SEQ ID NO:89), M62246_1_T14 (SEQ ID NO:90), M62246_1_T15 (SEQ ID NO:91), M62246_1_T16 (SEQ ID NO:92), M62246_1_T4 (SEQ ID NO:85), M62246_1_T6 (SEQ ID NO:86), M62246_1_T8 (SEQ ID NO:87) and M62246_1_T9 (SEQ ID NO:88). Table 125 below describes the starting and ending position of this segment on each transcript.

TABLE 125

Segment location on transcripts

| Transcript name | Segment starting position | Segment ending position |
|---|---|---|
| M62246_1_T12 (SEQ ID NO: 89) | 557 | 698 |
| M62246_1_T14 (SEQ ID NO: 90) | 377 | 518 |
| M62246_1_T15 (SEQ ID NO: 91) | 1003 | 1144 |
| M62246_1_T16 (SEQ ID NO: 92) | 223 | 364 |
| M62246_1_T4 (SEQ ID NO: 85) | 377 | 518 |
| M62246_1_T6 (SEQ ID NO: 86) | 377 | 518 |
| M62246_1_T8 (SEQ ID NO: 87) | 377 | 518 |
| M62246_1_T9 (SEQ ID NO: 88) | 377 | 518 |

Segment cluster M62246_1_N17 (SEQ ID NO:99) according to the present invention is supported by 62 libraries. The number of libraries was determined as previously described. This segment can be found in the following transcript(s): M62246_1_T12 (SEQ ID NO:89), M62246_1_T14 (SEQ ID NO:90), M62246_1_T15 (SEQ ID NO:91), M62246_1_T16 (SEQ ID NO:92), M62246_1_T4 (SEQ ID NO:85), M62246_1_T6 (SEQ ID NO:86), M62246_1_T8 (SEQ ID NO:87) and M62246_1_T9 (SEQ ID NO:88). Table 126 below describes the starting and ending position of this segment on each transcript.

TABLE 126

Segment location on transcripts

| Transcript name | Segment starting position | Segment ending position |
|---|---|---|
| M62246_1_T12 (SEQ ID NO: 89) | 699 | 912 |
| M62246_1_T14 (SEQ ID NO: 90) | 636 | 849 |
| M62246_1_T15 (SEQ ID NO: 91) | 1145 | 1358 |
| M62246_1_T16 (SEQ ID NO: 92) | 365 | 578 |
| M62246_1_T4 (SEQ ID NO: 85) | 636 | 849 |
| M62246_1_T6 (SEQ ID NO: 86) | 636 | 849 |
| M62246_1_T8 (SEQ ID NO: 87) | 519 | 732 |
| M62246_1_T9 (SEQ ID NO: 88) | 519 | 732 |

Segment cluster M62246_1_N18 (SEQ ID NO:100) according to the present invention is supported by 16 libraries. The number of libraries was determined as previously described. This segment can be found in the following transcript(s): M62246_1_T14 (SEQ ID NO:90). Table 127 below describes the starting and ending position of this segment on each transcript.

TABLE 127

Segment location on transcripts

| Transcript name | Segment starting position | Segment ending position |
|---|---|---|
| M62246_1_T14 (SEQ ID NO: 90) | 850 | 1066 |

Segment cluster M62246_1_N24 (SEQ ID NO:101) according to the present invention is supported by 105 libraries. The number of libraries was determined as previously described. This segment can be found in the following transcript(s): M62246_1_T12 (SEQ ID NO:89), M62246_1_T15 (SEQ ID NO:91), M62246_1_T16 (SEQ ID NO:92), M62246_1_T4 (SEQ ID NO:85), M62246_1_T6 (SEQ ID NO:86) and M62246_13_1_T8 (SEQ ID NO:87). Table 128 below describes the starting and ending position of this segment on each transcript.

TABLE 128

Segment location on transcripts

| Transcript name | Segment starting position | Segment ending position |
|---|---|---|
| M62246_1_T12 (SEQ ID NO: 89) | 1014 | 2155 |
| M62246_1_T15 (SEQ ID NO: 91) | 1460 | 2601 |
| M62246_1_T16 (SEQ ID NO: 92) | 680 | 1821 |
| M62246_1_T4 (SEQ ID NO: 85) | 951 | 2092 |
| M62246_1_T6 (SEQ ID NO: 86) | 951 | 1151 |
| M62246_1_T8 (SEQ ID NO: 87) | 888 | 2029 |

Segment cluster M62246_1_N26 (SEQ ID NO:102) according to the present invention is supported by 2 libraries. The number of libraries was determined as previously described. This segment can be found in the following transcript(s): M62246_1_T9 (SEQ ID NO:88). Table 129 below describes the starting and ending position of this segment on each transcript.

TABLE 129

Segment location on transcripts

| Transcript name | Segment starting position | Segment ending position |
|---|---|---|
| M62246_1_T9 (SEQ ID NO: 88) | 834 | 1362 |

According to an optional embodiment of the present invention, short segments related to the above cluster are also provided. These segments are up to about 120 bp in length, and so are included in a separate description.

Segment cluster M62246_1_N0 (SEQ ID NO:103) according to the present invention is supported by 3 libraries. The number of libraries was determined as previously described. This segment can be found in the following transcript(s): M62246_1_T16 (SEQ ID NO:92). Table 130 below describes the starting and ending position of this segment on each transcript.

TABLE 130

Segment location on transcripts

| Transcript name | Segment starting position | Segment ending position |
|---|---|---|
| M62246_1_T16 (SEQ ID NO: 92) | 1 | 101 |

Segment cluster M62246_1_N7 (SEQ ID NO:104) according to the present invention is supported by 42 libraries. The number of libraries was determined as previously described. This segment can be found in the following transcript(s): M62246_1_T12 (SEQ ID NO:89), M62246_1_T14 (SEQ ID NO:90), M62246_1_T15 (SEQ ID NO:91), M62246_1_T4 (SEQ ID NO:85), M62246_1_T6 (SEQ ID NO:86), M62246_1_T8 (SEQ ID NO:87) and M62246_1_T9 (SEQ ID NO:88). Table 131 below describes the starting and ending position of this segment on each transcript.

TABLE 131

Segment location on transcripts

| Transcript name | Segment starting position | Segment ending position |
|---|---|---|
| M62246_1_T12 (SEQ ID NO: 89) | 313 | 376 |
| M62246_1_T14 (SEQ ID NO: 90) | 313 | 376 |
| M62246_1_T15 (SEQ ID NO: 91) | 793 | 856 |
| M62246_1_T4 (SEQ ID NO: 85) | 313 | 376 |
| M62246_1_T6 (SEQ ID NO: 86) | 313 | 376 |
| M62246_1_T8 (SEQ ID NO: 87) | 313 | 376 |
| M62246_1_T9 (SEQ ID NO: 88) | 313 | 376 |

Segment cluster M62246_1_N15 (SEQ ID NO:105) according to the present invention is supported by 7 libraries. The number of libraries was determined as previously described. This segment can be found in the following transcript(s): M62246_1_T14 (SEQ ID NO:90), M62246_1_T4 (SEQ ID NO:85) and M62246_1_T6 (SEQ ID NO:86). Table 132 below describes the starting and ending position of this segment on each transcript.

TABLE 132

Segment location on transcripts

| Transcript name | Segment starting position | Segment ending position |
|---|---|---|
| M62246_1_T14 (SEQ ID NO: 90) | 519 | 635 |
| M62246_1_T4 (SEQ ID NO: 85) | 519 | 635 |
| M62246_1_T6 (SEQ ID NO: 86) | 519 | 635 |

Segment cluster M62246_1_N20 (SEQ ID NO:106) according to the present invention is supported by 2 libraries. The number of libraries was determined as previously described. This segment can be found in the following transcript(s): M62246_1_T8 (SEQ ID NO:87). Table 133 below describes the starting and ending position of this segment on each transcript.

TABLE 133

Segment location on transcripts

| Transcript name | Segment starting position | Segment ending position |
|---|---|---|
| M62246_1_T8 (SEQ ID NO: 87) | 733 | 786 |

Segment cluster M62246_1_N22 (SEQ ID NO:107) according to the present invention is supported by 31 libraries. The number of libraries was determined as previously described. This segment can be found in the following transcript(s): M62246_1_T12 (SEQ ID NO:89), M62246_1_T15 (SEQ ID NO:91), M62246_1_T16 (SEQ ID NO:92), M62246_1_T4 (SEQ ID NO:85), M62246_1_T6 (SEQ ID NO:86), M62246_1_T8 (SEQ ID NO:87) and M62246_1_T9 (SEQ ID NO:88). Table 134 below describes the starting and ending position of this segment on each transcript.

TABLE 134

Segment location on transcripts

| Transcript name | Segment starting position | Segment ending position |
|---|---|---|
| M62246_1_T12 (SEQ ID NO: 89) | 913 | 1013 |
| M62246_1_T15 (SEQ ID NO: 91) | 1359 | 1459 |

TABLE 134-continued

Segment location on transcripts

| Transcript name | Segment starting position | Segment ending position |
|---|---|---|
| M62246_1_T16 (SEQ ID NO: 92) | 579 | 679 |
| M62246_1_T4 (SEQ ID NO: 85) | 850 | 950 |
| M62246_1_T6 (SEQ ID NO: 86) | 850 | 950 |
| M62246_1_T8 (SEQ ID NO: 87) | 787 | 887 |
| M62246_1_T9 (SEQ ID NO: 88) | 733 | 833 |

The alignment of M62246 variant proteins to the previously known proteins is shown in the attached CD-Rom.

Expression of GPI-mannosyltransferase Subunit (M62246) Transcripts which are Detectable by Segment 18 (SEQ ID NO:100), in Normal and Cancerous Lung Tissues:

Expression of GPI-mannosyltransferase subunit (M62246) transcripts detectable by or according to segment 18, was measured with oligonucleotide-based micro-arrays. The results of image intensities for each feature were normalized according to the ninetieth percentile of the image intensities of all the features on the chip. Then, feature image intensities for replicates of the same oligonucleotide on the chip and replicates of the same sample were averaged. Outlying results were discarded.

Figure 13:
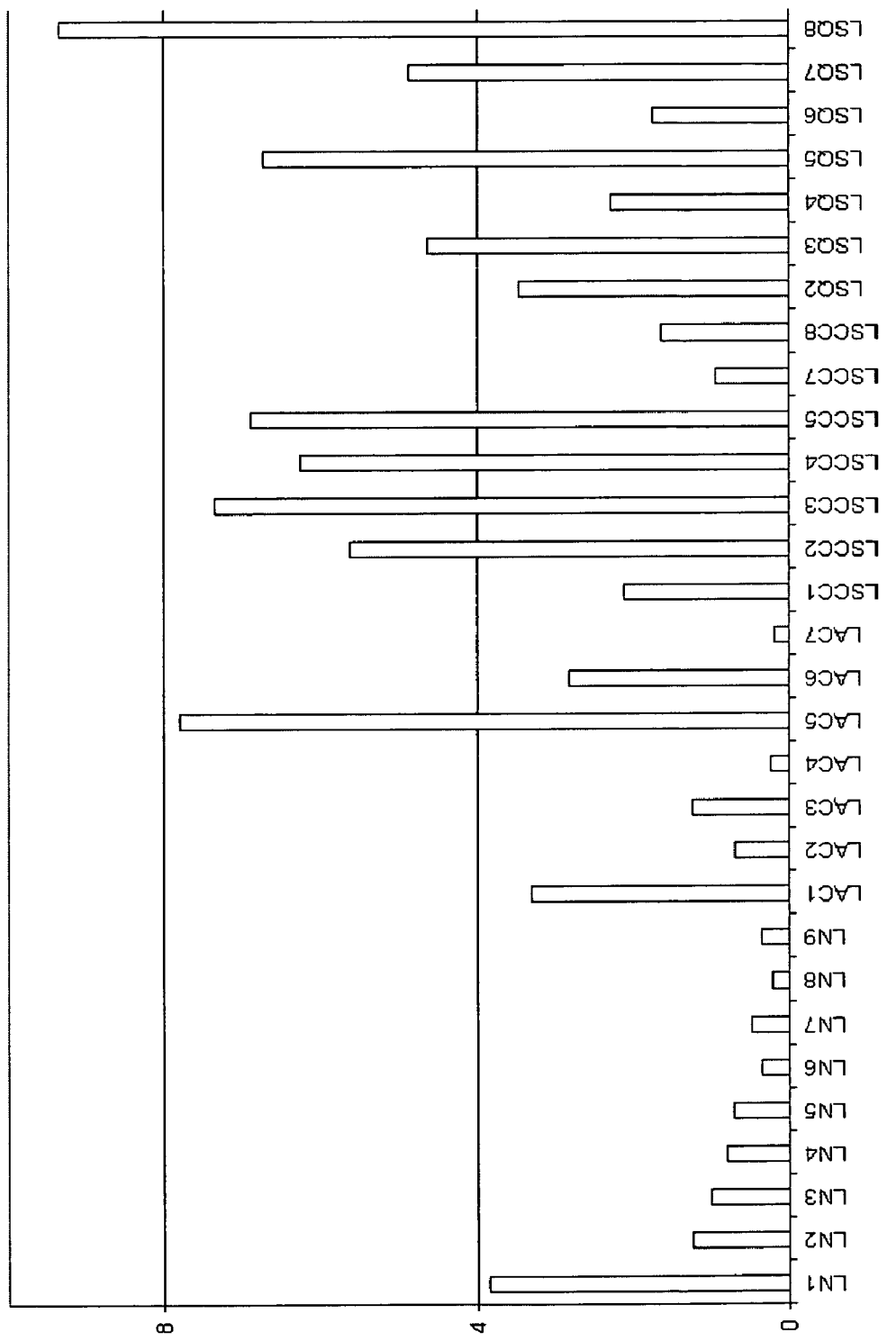
FIG. 13 is a histogram showing expression of of GPI-mannosyltransferase subunit (SEQ ID NO:108) (M62246) transcripts which are detectable by segment 18, in normal, and cancerous lung tissues.

For every oligonucleotide (M62246_0_0_21175 (SEQ ID NO:472)) the averaged intensity determined for every sample was divided by the averaged intensity of all the normal samples (Sample Nos. LN1-9, Table 2_7), to obtain a value of fold up-regulation for each sample relative to the averaged normal samples. These results are presented in a histogram in FIG. 13, showing expression of GPI-mannosyltransferase subunit (M62246) transcripts which are detectable by segment 18, in normal, and cancerous lung tissues.

As is evident from the histogram, the expression of GPI-mannosyltransferase subunit (M62246) transcripts detectable with the above oligonucleotides in cancer samples was higher than in the normal samples.

M62246_0_0_21175 sequence (SEQ ID NO:472):
AGAATAAAGGTATGGTGGCAAGTCCTC-
CTTCTGCTAGGCTGGCTGGCAAG Description for Cluster M78076

Cluster M78076 features 11 transcript(s) and 40 segment(s) of interest, the names for which are given in Tables 136 and 137, respectively, the sequences themselves are given at the end of the application. The selected protein variants are given in table 138.

TABLE 136

Transcripts of interest
Transcript Name

M78076_T5 (SEQ ID NO: 115)
M78076_T6 (SEQ ID NO: 116)
M78076_T7 (SEQ ID NO: 117)
M78076_T11 (SEQ ID NO: 118)
M78076_T12 (SEQ ID NO: 119)
M78076_T17 (SEQ ID NO: 120)
M78076_T18 (SEQ ID NO: 121)
M78076_T19 (SEQ ID NO: 122)
M78076_T24 (SEQ ID NO: 123)
M78076_T25 (SEQ ID NO: 124)
M78076_T27 (SEQ ID NO: 125)

TABLE 137

Segments of interest
Segment Name

M78076_N9 (SEQ ID NO: 126)
M78076_N14 (SEQ ID NO: 127)
M78076_N21 (SEQ ID NO: 128)
M78076_N25 (SEQ ID NO: 129)
M78076_N27 (SEQ ID NO: 130)
M78076_N29 (SEQ ID NO: 131)
M78076_N32 (SEQ ID NO: 132)
M78076_N35 (SEQ ID NO: 133)
M78076_N38 (SEQ ID NO: 134)
M78076_N42 (SEQ ID NO: 135)
M78076_N44 (SEQ ID NO: 136) (also called M78076 seg46)
M78076_N45 (SEQ ID NO: 137) (also called M78076 seg47)
M78076_N52 (SEQ ID NO: 138)
M78076_N0 (SEQ ID NO: 139)
M78076_N1 (SEQ ID NO: 140)
M78076_N2 (SEQ ID NO: 141)
M78076_N3 (SEQ ID NO: 142)
M78076_N5 (SEQ ID NO: 143)
M78076_N6 (SEQ ID NO: 144)
M78076_N11 (SEQ ID NO: 145)
M78076_N12 (SEQ ID NO: 146)
M78076_N17 (SEQ ID NO: 147)
M78076_N18 (SEQ ID NO: 148)
M78076_N19 (SEQ ID NO: 149)
M78076_N23 (SEQ ID NO: 150)
M78076_N28 (SEQ ID NO: 151)
M78076_N30 (SEQ ID NO: 152)
M78076_N31 (SEQ ID NO: 153)
M78076_N34 (SEQ ID NO: 154)
M78076_N36 (SEQ ID NO: 155)
M78076_N37 (SEQ ID NO: 156) (also called M78076 seg36)
M78076_N39 (SEQ ID NO: 157)
M78076_N40 (SEQ ID NO: 158)
M78076_N41 (SEQ ID NO: 159)
M78076_N43 (SEQ ID NO: 160) (also called M78076 seg45)
M78076_N47 (SEQ ID NO: 161)
M78076_N48 (SEQ ID NO: 162)
M78076_N49 (SEQ ID NO: 163)
M78076_N50 (SEQ ID NO: 164)
M78076_N51 (SEQ ID NO: 165)

TABLE 138

Proteins of interest

| Protein Name | Corresponding Transcript(s) |
|---|---|
| M78076_P5 (SEQ ID NO: 169) | M78076_T12 (SEQ ID NO: 119); M78076_T5 (SEQ ID NO: 115) |
| M78076_P6 (SEQ ID NO: 170) | M78076_T6 (SEQ ID NO: 116) |
| M78076_P7 (SEQ ID NO: 171) | M78076_T17 (SEQ ID NO: 120); M78076_T7 (SEQ ID NO: 117) |
| M78076_P11 (SEQ ID NO: 172) | M78076_T11 (SEQ ID NO: 118) |
| M78076_P16 (SEQ ID NO: 173) | M78076_T18 (SEQ ID NO: 121) |
| M78076_P17 (SEQ ID NO: 174) | M78076_T19 (SEQ ID NO: 122) |
| M78076_P22 (SEQ ID NO: 175) | M78076_T24 (SEQ ID NO: 123) |
| M78076_P23 (SEQ ID NO: 176) | M78076_T25 (SEQ ID NO: 124) |
| M78076_P25 (SEQ ID NO: 177) | M78076_T27 (SEQ ID NO: 125) |

These sequences are variants of the known protein Amyloid-like protein 1 precursor (SEQ ID NO:166) (SwissProt accession identifier APLP1_HUMAN (SEQ ID NO:591); known also according to the synonyms APLP; APLP-1), referred to herein as the previously known protein.

Protein Amyloid-like protein I precursor (SEQ ID NO:166) is known or believed to have the following function(s): May play a role in postsynaptic function. The C-terminal gamma-secretase processed fragment, ALID1, activates transcription activation through APBB1 (Fe65) binding (By similarity). Couples to JIP signal transduction through C-terminal binding. May interact with cellular G-protein signaling pathways. Can regulate neurite outgrowth through binding to components of the extracellular matrix such as heparin and collagen I.;The gamma-CTF peptide, C30, is a potent enhancer of neuronal apoptosis (By similarity). The sequence for protein Amyloid-like protein 1 precursor (SEQ ID NO:166) is given at the end of the application, as "Amyloid-like protein 1 precursor (SEQ ID NO:166) amino acid sequence". Known polymorphisms for this sequence are as shown in Table 139.

TABLE 139

Amino acid mutations for Known Protein

| SNP position(s) on amino acid sequence | Comment |
| --- | --- |
| 48 | A -> P |

Protein Amyloid-like protein 1 precursor (SEQ ID NO:166) localization is believed to be Type I membrane protein C-terminally processed in the Golgi complex.

The following GO Annotation(s) apply to the previously known protein. The following annotation(s) were found: neurogenesis, which are annotation(s) related to Biological Process; and basement membrane, which are annotation(s) related to Cellular Component.

The GO assignment relies on information from one or more of the SwissProt/TremB 1 Protein knowledgebase, available from <. expasy.ch/sprot/>; or Locuslink, available from <.ncbi .nlm.nih.gov/projects/LocusLinkl>.

As noted above, cluster M78076 features 11 transcript(s), which were listed in Table 136 above. These transcript(s) encode for protein(s) which are variant(s) of protein Amyloid-like protein 1 precursor (SEQ ID NO:166). A description of each variant protein according to the present invention is now provided.

Variant protein M78076_P5 (SEQ ID NO:169) according to the present invention has an amino acid sequence as given at the end of the application; it is encoded by transcript(s) M78076_T12 (SEQ ID NO:119) and M78076_T5 (SEQ ID NO:115). An alignment is given to the known protein (Amyloid-like protein 1 precursor (SEQ ID NO:166)) at the end of the application. One or more alignments to one or more previously published protein sequences are given at the end of the application. A brief description of the relationship of the variant protein according to the present invention to each such aligned protein is as follows:

1. Comparison Report Between M78076_P5 (SEQ ID NO:169) and APLP1_HUMAN (SEQ ID NO:591):

A. An isolated chimeric polypeptide encoding for M78076_P5 (SEQ ID NO:169), comprising a first amino acid sequence being at least 90% homologous to MGPASPAAR-GLSRRPGQPPLPLLLPLLLLLLRAQ-PAIGSLAGGSPGAAEAPGSAQVAGLCG RLTLHRDL-RTGRWEPDPQRSRRCLRDPQRVLEYCRQMYPELQIA RVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSI LQTL EEQVSGERQRLVETHATRVIALINDQR-RAALEGFLAALQADPPQAERVLLALRRYLRAEQ KEQRHTLRHYQHVAAVDPEKAQQMR-FQVHTHLQVIEERVNQSLGLLDQNPHLAQELRP QIQELLHSEHLGPSELEAPAPGGSSED-KGGLQPPDSKD corresponding to amino acids 1-517 of APLP1_HUMAN (SEQ ID NO:591), which also corresponds to amino acids 1-517 of M78076_P5 (SEQ ID NO:169), and a second amino acid sequence having the sequence GE corresponding to amino acids 518-519 of M78076_P5 (SEQ ID NO:169), wherein said first amino acid sequence and second amino acid sequence are contiguous and in a sequential order.

2. Comparison Report Between M78076_P5 (SEQ ID NO:169) and NP_005157 (SEQ ID NO:167):

A. An isolated chimeric polypeptide encoding for M78076_P5 (SEQ ID NO:169), comprising a first amino acid sequence being at least 90% homologous to MGPASPAAR-GLSRRPGQPPLPLLLPLLLLLLRAQ-PAIGSLAGGSPGAAEAPGSAQVAGLCG RLTLHRDL-RTGRWEPDPQRSRRCLRDPQRVLEYCRQMYPELQIA RVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSI LQTL EEQVSGERQRLVETHATRVIALINDQR-RAALEGFLAALQADPPQAERVLLALRRYLRAEQ KEQRHTLRHYQHVAAVDPEKAQQMR-FQVHTHLQVIEERVNQSLGLLDQNPHLAQELRP QIQELLHSEHLGPSELEAPAPGGSSED-KGGLQPPDSKD corresponding to amino acids 1-517 of NP_005157 (SEQ ID NO:167), which also corresponds to amino acids 1-517 of M78076_P5 (SEQ ID NO:169), and a second amino acid sequence having the sequence GE corresponding to amino acids 518-519 of M78076_P5 (SEQ ID NO:169), wherein said first amino acid sequence and second amino acid sequence are contiguous and in a sequential order.

The localization of the variant protein was determined according to results from a number of different software programs and analyses, including analyses from SignalP and other specialized programs. The variant protein is believed to be located as follows with regard to the cell: secreted.

Variant protein M78076_P5 (SEQ ID NO:169) also has the following non-silent SNPs (Single Nucleotide Polymorphisms) as listed in Table 140, (given according to their position(s) on the amino acid sequence, with the alternative amino acid(s) listed; the last column indicates whether the SNP is known or not; the presence of known SNPs in variant protein M78076_P5 (SEQ ID NO:169) sequence provides support for the deduced sequence of this variant protein according to the present invention).

TABLE 140

Amino acid mutations

| SNP position(s) on amino acid sequence | Alternative amino acid(s) | Previously known SNP? |
| --- | --- | --- |
| 4 | A -> P | Yes |
| 6 | P -> H | Yes |
| 13 | R -> H | Yes |
| 34 | Q -> | No |

TABLE 140-continued

Amino acid mutations

| SNP position(s) on amino acid sequence | Alternative amino acid(s) | Previously known SNP? |
|---|---|---|
| 38 | G -> R | Yes |
| 88 | P -> R | Yes |
| 124 | R -> Q | Yes |
| 214 | G -> | No |
| 214 | G -> R | No |
| 215 | T -> | No |
| 215 | T -> N | No |
| 232 | P -> | No |
| 262 | Q -> | No |
| 309 | G -> E | Yes |
| 370 | Q -> | No |

The glycosylation sites of variant protein M78076_P5 (SEQ ID NO:169), as compared to the known protein Amyloid-like protein 1 precursor (SEQ ID NO:166), are described in Table 141 (given according to their position(s) on the amino acid sequence in the first column; the second column indicates whether the glycosylation site is present in the variant protein; and the last column indicates whether the position is different on the variant protein).

TABLE 141

Glycosylation site(s)

| Position(s) on known amino acid sequence | Present in variant protein? | Position(s) on variant protein |
|---|---|---|
| 337 | Yes | 337 |
| 461 | Yes | 461 |
| 551 | No | |

Variant protein M78076_P5 (SEQ ID NO:169) is encoded by the following transcript(s): M78076_T12 (SEQ ID NO:119) and M78076_T5 (SEQ ID NO:115), for which the sequence(s) is/are given at the end of the application.

The coding portion of transcript M78076_T12 (SEQ ID NO:119) is shown in bold; this coding portion starts at position 139 and ends at position 1695. The transcript also has the following SNPs as listed in Table 142 (given according to their position on the nucleotide sequence, with the alternative nucleic acid listed; the last column indicates whether the SNP is known or not; the presence of known SNPs in variant protein M78076_P5 (SEQ ID NO:169) sequence provides support for the deduced sequence of this variant protein according to the present invention).

TABLE 142

Nucleic acid SNPs

| SNP position(s) on nucleotide sequence | Alternative nucleic acid(s) | Previously known SNP? |
|---|---|---|
| 111 | G -> | No |
| 113 | G -> C | No |
| 113 | G -> T | No |
| 148 | G -> C | Yes |
| 155 | C -> A | Yes |
| 176 | G -> A | Yes |
| 216 | A -> G | Yes |
| 240 | G -> | No |
| 250 | G -> A | Yes |
| 312 | A -> G | Yes |
| 363 | A -> G | Yes |
| 401 | C -> G | Yes |
| 509 | G -> A | Yes |
| 778 | G -> A | No |
| 778 | G -> | No |
| 782 | C -> A | No |
| 782 | C -> | No |
| 832 | C -> | No |
| 924 | G -> | No |
| 1064 | G -> A | Yes |
| 1074 | G -> A | Yes |
| 1248 | G -> | No |
| 1395 | G -> T | Yes |
| 1420 | C -> T | Yes |
| 2073 | G -> A | Yes |
| 2618 | G -> A | Yes |
| 2696 | C -> | No |
| 2696 | C -> T | No |
| 2834 | C -> T | Yes |
| 2985 | A -> G | No |
| 3054 | T -> | No |
| 3061 | T -> | No |
| 3128 | C -> T | Yes |

The coding portion of transcript M78076_T5 (SEQ ID NO:115) is shown in bold; this coding portion starts at position 139 and ends at position 1695. The transcript also has the following SNPs as listed in Table 143 (given according to their position on the nucleotide sequence, with the alternative nucleic acid listed; the last column indicates whether the SNP is known or not; the presence of known SNPs in variant protein M78076_P5 (SEQ ID NO:169) sequence provides support for the deduced sequence of this variant protein according to the present invention).

TABLE 143

Nucleic acid SNPs

| SNP position(s) on nucleotide sequence | Alternative nucleic acid(s) | Previously known SNP? |
|---|---|---|
| 111 | G -> | No |
| 113 | G -> C | No |
| 113 | G -> T | No |
| 148 | G -> C | Yes |
| 155 | C -> A | Yes |
| 176 | G -> A | Yes |
| 216 | A -> G | Yes |
| 240 | G -> | No |
| 250 | G -> A | Yes |
| 312 | A -> G | Yes |
| 363 | A -> G | Yes |
| 401 | C -> G | Yes |
| 509 | G -> A | Yes |
| 778 | G -> A | No |
| 778 | G -> | No |
| 782 | C -> A | No |
| 782 | C -> | No |
| 832 | C -> | No |
| 924 | G -> | No |
| 1064 | G -> A | Yes |
| 1074 | G -> A | Yes |
| 1248 | G -> | No |
| 1395 | G -> T | Yes |
| 1420 | C -> T | Yes |
| 2143 | G -> A | Yes |
| 2221 | C -> | No |
| 2221 | C -> T | No |
| 2359 | C -> T | Yes |
| 2510 | A -> G | No |
| 2579 | T -> | No |

TABLE 143-continued

Nucleic acid SNPs

| SNP position(s) on nucleotide sequence | Alternative nucleic acid(s) | Previously known SNP? |
|---|---|---|
| 2586 | T -> | No |
| 2653 | C -> T | Yes |

Variant protein M78076_P6 (SEQ ID NO:170) according to the present invention has an amino acid sequence as given at the end of the application; it is encoded by transcript(s) M78076_T6 (SEQ ID NO:116). An alignment is given to the known protein (Amyloid-like protein 1 precursor (SEQ ID NO:166)) at the end of the application. One or more alignments to one or more previously published protein sequences are given at the end of the application. A brief description of the relationship of the variant protein according to the present invention to each such aligned protein is as follows:

1. Comparison Report Between M78076_P6 (SEQ ID NO:170) and APLP1_HUMAN (SEQ ID NO:591):

A. An isolated chimeric polypeptide encoding for M78076_P6 (SEQ ID NO:170), comprising a first amino acid sequence being at least 90% homologous to MGPASPAAR-GLSRRPGQPPLPLLLPLLLLLLRAQ-PAIGSLAGGSPGAAEAPGSAQVAGLCG RLTLHRDL-RTGRWEPDPQRSRRCLRDPQRVLEYCRQMYPELQIA RVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSI LQTL EEQVSGERQRLVETHATRVIALINDQR-RAALEGFLAALQADPPQAERVLLALRRYLRAEQ KEQRHTLRHYQHVAAVDPEKAQQMR-FQVHTHLQVIEERVNQSLGLLDQNPHLAQELRP QIQELLHSEHLGPSELEAPAPGGSSED-KGGLQPPDSKDDTPMTLPK corresponding to amino acids 1-525 of APLP1_HUMAN (SEQ ID NO:591), which also corresponds to amino acids 1-525 of M78076_P6 (SEQ ID NO:170), a second amino acid sequence being at least 70%, optionally at least 80%, preferably at least 85%, more preferably at least 90% and most preferably at least 95% homologous to a polypeptide having the sequence DLGV (SEQ ID NO:551) corresponding to amino acids 526-529 of M78076_P6 (SEQ ID NO:170), and a third amino acid sequence being at least 90% homologous to GSTEQDAAS-PEKEKMNPLEQYERKVNASVPRGFPFH-SSEIQRDELAPAGTGVSREAVSGL LIMGAGGGSLIV-LSMLLLRRKKPYGAISHGVVEVDPMLTLEEQQLREL QRHGYENPTYRF LEERP corresponding to amino acids 526-650 of APLP1_HUMAN (SEQ ID NO:591), which also corresponds to amino acids 530-654 of M78076_P6 (SEQ ID NO:170), wherein said first amino acid sequence, second amino acid sequence and third amino acid sequence are contiguous and in a sequential order.

B. An isolated polypeptide encoding for an edge portion of M78076_P6 (SEQ ID NO:170), comprising an amino acid sequence being at least 70%, optionally at least about 80%, preferably at least about 85%, more preferably at least about 90% and most preferably at least about 95% homologous to the sequence DLGV (SEQ ID NO:551) of M78076_P6 (SEQ ID NO:170).

2. Comparison Report Between M78076_P6 (SEQ ID NO:170) and NP_005157 (SEQ ID NO:167):

A. An isolated chimeric polypeptide encoding for M78076_P6 (SEQ ID NO:170), comprising a first amino acid sequence being at least 90% homologous to MGPASPAAR-GLSRRPGQPPLPLLLPLLLLLLRAQ-PAIGSLAGGSPGAAEAPGSAQVAGLCG RLTLHRDL-RTGRWEPDPQRSRRCLRDPQRVLEYCRQMYPELQIA RVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMR-FQVHTHLQVIEERVNQSLGLLDQNPHLAQELRP QIQELLHSEHLGPSELEAPAPGGSSED-KGGLQPPDSKDDTPMTLPK corresponding to amino acids 1-525 of NP_005157 (SEQ ID NO:167), which also corresponds to amino acids 1-525 of M78076_P6 (SEQ ID NO:170), a second amino acid sequence being at least 70%, optionally at least 80%, preferably at least 85%, more preferably at least 90% and most preferably at least 95% homologous to a polypeptide having the sequence DLGV (SEQ ID NO:551) corresponding to amino acids 526-529 of M78076_P6 (SEQ ID NO:170), and a third amino acid sequence being at least 90% homologous to GSTEQDAAS-PEKEKMNPLEQYERKVNASVPRGFPFH-SSEIQRDELAPAGTGVSREAVSGL LIMGAGGGSLIV-LSMLLLRRKKPYGAISHGVVEVDPMLTLEEQQLREL QRHGYENPTYRF LEERP corresponding to amino acids 526-650 of NP_005157 (SEQ ID NO:167), which also corresponds to amino acids 530-654 of M78076_P6 (SEQ ID NO:170), wherein said first amino acid sequence, second amino acid sequence and third amino acid sequence are contiguous and in a sequential order.

B. An isolated polypeptide encoding for an edge portion of M78076_P6 (SEQ ID NO:170), comprising an amino acid sequence being at least 70%, optionally at least about 80%, preferably at least about 85%, more preferably at least about 90% and most preferably at least about 95% homologous to the sequence DLGV (SEQ ID NO:551) of M78076_P6 (SEQ ID NO:170).

The localization of the variant protein was determined according to results from a number of different software programs and analyses, including analyses from SignalP and other specialized programs. The variant protein is believed to be located as follows with regard to the cell: membrane.

Variant protein M78076_P6 (SEQ ID NO:170) also has the following non-silent SNPs (Single Nucleotide Polymorphisms) as listed in Table 144, (given according to their position(s) on the amino acid sequence, with the alternative amino acid(s) listed; the last column indicates whether the SNP is known or not; the presence of known SNPs in variant protein M78076_P6 (SEQ ID NO:170) sequence provides support for the deduced sequence of this variant protein according to the present invention).

TABLE 144

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 214 | G -> | No |
| 214 | G -> R | No |
| 215 | T -> | No |
| 215 | T -> N | No |
| 232 | P -> | No |
| 262 | Q -> | No |
| 309 | G -> E | Yes |
| 370 | Q -> | No |
| 612 | P -> | No |

The glycosylation sites of variant protein M78076_P6 (SEQ ID NO:170), as compared to the known protein Amyloid-like protein 1 precursor (SEQ ID NO:166), are described in Table 145 (given according to their position(s) on the amino acid sequence in the first column; the second column indicates whether the glycosylation site is present in the variant protein; and the last column indicates whether the position is different on the variant protein).

TABLE 145

Glycosylation site(s)

| Position(s) on known amino acid sequence | Present in variant protein? | Position(s) on variant protein |
|---|---|---|
| 337 | Yes | 337 |
| 461 | Yes | 461 |
| 555 | Yes | 555 |

Variant protein M78076_P6 (SEQ ID NO:170) is encoded by the following transcript(s): M78076_T6 (SEQ ID NO:116), for which the sequence(s) is/are given at the end of the application. The coding portion of transcript M78076_T6 (SEQ ID NO:1 16) is shown in bold; this coding portion starts at position 139 and ends at position 2100. The transcript also has the following SNPs as listed in Table 146 (given according to their position on the nucleotide sequence, with the alternative nucleic acid listed; the last column indicates whether the SNP is known or not; the presence of known SNPs in variant protein M78076_P6 (SEQ ID NO:170) sequence provides support for the deduced sequence of this variant protein according to the present invention).

TABLE 146

Nucleic acid SNPs

| SNP position(s) on nucleotide sequence | Alternative nucleic acid(s) | Previously known SNP? |
|---|---|---|
| 111 | G -> | No |
| 113 | G -> C | No |
| 113 | G -> T | No |
| 148 | G -> C | Yes |
| 155 | C -> A | Yes |
| 176 | G -> A | Yes |
| 216 | A -> G | Yes |
| 240 | G -> | No |

TABLE 146-continued

Nucleic acid SNPs

| SNP position(s) on nucleotide sequence | Alternative nucleic acid(s) | Previously known SNP? |
|---|---|---|
| 250 | G -> A | Yes |
| 312 | A -> G | Yes |
| 363 | A -> G | Yes |
| 401 | C -> G | Yes |
| 509 | G -> A | Yes |
| 778 | G -> A | No |
| 778 | G -> | No |
| 782 | C -> A | No |
| 782 | C -> | No |
| 832 | C -> | No |
| 924 | G -> | No |
| 1064 | G -> A | Yes |
| 1074 | G -> A | Yes |
| 1248 | G -> | No |
| 1395 | G -> T | Yes |
| 1420 | C -> T | Yes |
| 1896 | G -> A | Yes |
| 1974 | C -> | No |
| 1974 | C -> T | No |
| 2112 | C -> T | Yes |
| 2263 | A -> G | No |
| 2332 | T -> | No |
| 2339 | T -> | No |
| 2406 | C -> T | Yes |

Variant protein M78076_P7 (SEQ ID NO:171) according to the present invention has an amino acid sequence as given at the end of the application; it is encoded by transcript(s) M78076_T17 (SEQ ID NO:120) and M78076_T7 (SEQ ID NO:117). An alignment is given to the known protein (Amyloid-like protein 1 precursor (SEQ ID NO:166)) at the end of the application. One or more alignments to one or more previously published protein sequences are given at the end of the application. A brief description of the relationship of the variant protein according to the present invention to each such aligned protein is as follows:

1. Comparison Report Between M78076_P7 (SEQ ID NO:171) and APLP1_HUMAN (SEQ ID NO:591):

A. An isolated chimeric polypeptide encoding for M78076_P7 (SEQ ID NO:171), comprising a first amino acid sequence being at least 90% homologous to MGPASPAAR-GLSRRPGQPPLPLLLPLLLLLLRAQ-PAIGSLAGGSPGAAEAPGSAQVAGLCG RLTLHRDL-RTGRWEPDPQRSRRCLRDPQRVLEYCRQMYPELQIA RVEQATQAIPMERWC GGSRSGSCAHPHHQVVPFR-CLPGEFVSEALLVPEGCRFLHQERM-
DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-
PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMR-FQVHTHLQVIEERVNQSLGLLDQNPHLAQELRP QIQELLHSEHLGPSELEAPAPGGSSED-
KGGLQPPDSKDDTPMTLPKG corresponding to amino acids 1-526 of APLP1_HUMAN (SEQ ID NO:591), which also corresponds to amino acids 1-526 of M78076_P7 (SEQ ID NO:171), and a second amino acid sequence being at least 70%, optionally at least 80%, preferably at least 85%, more preferably at least 90% and most preferably at least 95% homologous to a polypeptide having the sequence ECLTVNPSLQIPLNP (SEQ ID NO:552) corresponding to amino acids 527-541 of M78076_P7 (SEQ ID NO:171), wherein said first amino acid sequence and second amino acid sequence are contiguous and in a sequential order.

B. An isolated polypeptide encoding for an edge portion of M78076_P7 (SEQ ID NO:171), comprising an amino acid sequence being at least 70%, optionally at least about 80%, preferably at least about 85%, more preferably at least about 90% and most preferably at least about 95% homologous to the sequence ECLTVNPSLQIPLNP (SEQ ID NO:552) of M78076_P7 (SEQ ID NO:171).

2. Comparison Report Between M78076_P7 (SEQ ID NO:171) and NP_005157 (SEQ ID NO:167):

A. An isolated chimeric polypeptide encoding for M78076_P7 (SEQ ID NO:171), comprising a first amino acid sequence being at least 90% homologous to MGPASPAAR-GLSRRPGQPPLPLLLPLLLLLLRAQ-PAIGSLAGGSPGAAEAPGSAQVAGLCG RLTLHRDL-RTGRWEPDPQRSRRCLRDPQRVLEYCRQMYPELQIA RVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMR-FQVHTHLQVIEERVNQSLGLLDQNPHLAQELRP QIQELLHSEHLGPSELEAPAPGGSSED-KGGLQPPDSKDDTPMTLPKG corresponding to amino acids 1-526 of NP_005157 (SEQ ID NO:167), which also corresponds to amino acids 1-526 of M78076_P7 (SEQ ID NO:171), and a second amino acid sequence being at least 70%, optionally at least 80%, preferably at least 85%, more preferably at least 90% and most preferably at least 95% homologous to a polypeptide having the sequence ECLTVNPSLQIPLNP (SEQ ID NO:552) corresponding to amino acids 527-541 of M78076_P7 (SEQ ID NO:171), wherein said first amino acid sequence and second amino acid sequence are contiguous and in a sequential order.

B. An isolated polypeptide encoding for an edge portion of M78076_P7 (SEQ ID NO:171), comprising an amino acid sequence being at least 70%, optionally at least about 80%, preferably at least about 85%, more preferably at least about 90% and most preferably at least about 95% homologous to the sequence ECLTVNPSLQIPLNP (SEQ ID NO:552) of M78076_P7 (SEQ ID NO:171).

The localization of the variant protein was determined according to results from a number of different software programs and analyses, including analyses from SignalP and other specialized programs. The variant protein is believed to be located as follows with regard to the cell: secreted.

Variant protein M78076_P7 (SEQ ID NO:171) also has the following non-silent SNPs (Single Nucleotide Polymorphisms) as listed in Table 147, (given according to their position(s) on the amino acid sequence, with the alternative amino acid(s) listed; the last column indicates whether the SNP is known or not; the presence of known SNPs in variant protein M78076_P7 (SEQ ID NO:171) sequence provides support for the deduced sequence of this variant protein according to the present invention).

TABLE 147

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 214 | G -> | No |
| 214 | G -> R | No |
| 215 | T -> | No |
| 215 | T -> N | No |
| 232 | P -> | No |
| 262 | Q -> | No |
| 309 | G -> E | Yes |
| 370 | Q -> | No |

The glycosylation sites of variant protein M78076_P7 (SEQ ID NO:171), as compared to the known protein Amyloid-like protein 1 precursor (SEQ ID NO:166), are described in Table 148 (given according to their position(s) on the amino acid sequence in the first column; the second column indicates whether the glycosylation site is present in the variant protein; and the last column indicates whether the position is different on the variant protein).

TABLE 148

Glycosylation site(s)

| Position(s) on known amino acid sequence | Present in variant protein? | Position(s) on variant protein |
|---|---|---|
| 337 | Yes | 337 |
| 461 | Yes | 461 |
| 551 | No | |

Variant protein M78076_P7 (SEQ ID NO:171) is encoded by the following transcript(s): M78076_T17 (SEQ ID NO:120) and M78076_T7 (SEQ ID NO:117), for which the sequence(s) is/are given at the end of the application.

The coding portion of transcript M78076_T17 (SEQ ID NO:120) is shown in bold; this coding portion starts at position 139 and ends at position 1761. The transcript also has the following SNPs as listed in Table 149 (given according to their position on the nucleotide sequence, with the alternative nucleic acid listed; the last column indicates whether the SNP is known or not; the presence of known SNPs in variant protein M78076 P7 (SEQ ID NO:171) sequence provides support for the deduced sequence of this variant protein according to the present invention).

TABLE 149

Nucleic acid SNPs

| SNP position(s) on nucleotide sequence | Alternative nucleic acid(s) | Previously known SNP? |
|---|---|---|
| 111 | G -> | No |
| 113 | G -> C | No |
| 113 | G -> T | No |
| 148 | G -> C | Yes |
| 155 | C -> A | Yes |
| 176 | G -> A | Yes |
| 216 | A -> G | Yes |
| 240 | G -> | No |

TABLE 149-continued

Nucleic acid SNPs

| SNP position(s) on nucleotide sequence | Alternative nucleic acid(s) | Previously known SNP? |
|---|---|---|
| 250 | G -> A | Yes |
| 312 | A -> G | Yes |
| 363 | A -> G | Yes |
| 401 | C -> G | Yes |
| 509 | G -> A | Yes |
| 778 | G -> A | No |
| 778 | G -> | No |
| 782 | C -> A | No |
| 782 | C -> | No |
| 832 | C -> | No |
| 924 | G -> | No |
| 1064 | G -> A | Yes |
| 1074 | G -> A | Yes |
| 1248 | G -> | No |
| 1395 | G -> T | Yes |
| 1420 | C -> T | Yes |
| 1814 | G -> A | Yes |
| 2594 | G -> A | Yes |
| 2672 | C -> | No |
| 2672 | C -> T | No |
| 2810 | C -> T | Yes |
| 2961 | A -> G | No |
| 3030 | T -> | No |
| 3037 | T -> | No |
| 3104 | C -> T | Yes |

The coding portion of transcript M78076_T7 (SEQ ID NO:117) is shown in bold; this coding portion starts at position 139 and ends at position 1761. The transcript also has the following SNPs as listed in Table 150 (given according to their position on the nucleotide sequence, with the alternative nucleic acid listed; the last column indicates whether the SNP is known or not; the presence of known SNPs in variant protein M78076_P7 (SEQ ID NO:171) sequence provides support for the deduced sequence of this variant protein according to the present invention).

TABLE 150

Nucleic acid SNPs

| SNP position(s) on nucleotide sequence | Alternative nucleic acid(s) | Previously known SNP? |
|---|---|---|
| 111 | G -> | No |
| 113 | G -> C | No |
| 113 | G -> T | No |
| 148 | G -> C | Yes |
| 155 | C -> A | Yes |
| 176 | G -> A | Yes |
| 216 | A -> G | Yes |
| 240 | G -> | No |
| 250 | G -> A | Yes |
| 312 | A -> G | Yes |
| 363 | A -> G | Yes |
| 401 | C -> G | Yes |
| 509 | G -> A | Yes |
| 778 | G -> A | No |
| 778 | G -> | No |
| 782 | C -> A | No |
| 782 | C -> | No |
| 832 | C -> | No |
| 924 | G -> | No |
| 1064 | G -> A | Yes |
| 1074 | G -> A | Yes |
| 1248 | G -> | No |
| 1395 | G -> T | Yes |
| 1420 | C -> T | Yes |
| 1814 | G -> A | Yes |
| 2359 | G -> A | Yes |
| 2437 | C -> | No |
| 2437 | C -> T | No |
| 2575 | C -> T | Yes |
| 2726 | A -> G | No |
| 2795 | T -> | No |
| 2802 | T -> | No |
| 2869 | C -> T | Yes |

Variant protein M78076_P11 (SEQ ID NO:172) according to the present invention has an amino acid sequence as given at the end of the application; it is encoded by transcript(s) M78076_T11 (SEQ ID NO:118). An alignment is given to the known protein (Amyloid-like protein 1 precursor (SEQ ID NO:166)) at the end of the application. One or more alignments to one or more previously published protein sequences are given at the end of the application. A brief description of the relationship of the variant protein according to the present invention to each such aligned protein is as follows:

1. Comparison Report Between M78076_P11 (SEQ ID NO:172) and APLP1_HUMAN (SEQ ID NO:591):

A. An isolated chimeric polypeptide encoding for M78076_P11 (SEQ ID NO:172), comprising a first amino acid sequence being at least 90% homologous to MGPASPAARGLSRRPGQPPLPLLL-PLLLLLLRAQPAIGSLAGGSPGAAEAPGSAQVAGLCG RLTLHRDLRTGRWEPDPQRSRRCLRD-PQRVLEYCRQMYPELQIARVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMR-FQVHTHLQVIEERVNQSLGLLDQNPHLAQELRP QIQELLHSEHLGPSELEAPAPGGSSED-KGGLQPPDSKDDTPMTLPKGSTEQDAASPEKEKM NPLEQYERKVNASVPRGFPFHSSEIQRDEL corresponding to amino acids 1-570 of APLP1_HUMAN (SEQ ID NO:591), which also corresponds to amino acids 1-570 of M78076_P11 (SEQ ID NO:172), and a second amino acid sequence being at least 70%, optionally at least 80%, preferably at least 85%, more preferably at least 90% and most preferably at least 95% homologous to a polypeptide having the sequence VRGGTAGYLGEETRGQRPGCDSQSHT-GPSKKPSAPSPLPAGTSWDRGVP (SEQ ID NO:553) corresponding to amino acids 571-619 of M78076_P11 (SEQ ID NO:172), wherein said first amino acid sequence and second amino acid sequence are contiguous and in a sequential order.

B. An isolated polypeptide encoding for an edge portion of M78076_P 11 (SEQ ID NO:172), comprising an amino acid sequence being at least 70%, optionally at least about 80%, preferably at least about 85%, more preferably at least about 90% and most preferably at least about 95% homologous to the sequence VRGGTAGYLGEETRGQRPGCDSQSHT- GPSKKPSAPSPLPAGTSWDRGVP (SEQ ID NO:553) of M78076_P11 (SEQ ID NO:172).

2. Comparison Report Between M78076_P11 (SEQ ID NO:172) and NP_005157 (SEQ ID NO:167):

A. An isolated chimeric polypeptide encoding for M78076_P11 (SEQ ID NO:172), comprising a first amino acid sequence being at least 90% homologous to MGPASPAARGLSRRPGQPPLPLLL-PLLLLLLRAQPAIGSLAGGSPGAAEAPGSAQVAGLCG RLTLHRDLRTGRWEPDPQRSRRCLRD-PQRVLEYCRQMYPELQIARVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMR-FQVHTHLQVIEERVNQSLGLLDQNPHLAQELRP QIQELLHSEHLGPSELEAPAPGGSSED-KGGLQPPDSKDDTPMTLPKGSTEQDAASPEKEKM NPLEQYERKVNASVPRGFPFHSSEIQRDEL corresponding to amino acids 1-570 of NP_005157 (SEQ ID NO:167), which also corresponds to amino acids 1-570 of M78076_P11 (SEQ ID NO:172), and a second amino acid sequence being at least 70%, optionally at least 80%, preferably at least 85%, more preferably at least 90% and most preferably at least 95% homologous to a polypeptide having the sequence VRGGTAGYLGEETRGQRPGCDSQSHT-GPSKKPSAPSPLPAGTSWDRGVP (SEQ ID NO:553) corresponding to amino acids 571-619 of M78076_P11 (SEQ ID NO:172), wherein said first amino acid sequence and second amino acid sequence are contiguous and in a sequential order.

B. An isolated polypeptide encoding for an edge portion of M78076_P11 (SEQ ID NO:172), comprising an amino acid sequence being at least 70%, optionally at least about 80%, preferably at least about 85%, more preferably at least about 90% and most preferably at least about 95% homologous to the sequence VRGGTAGYLGEETRGQRPGCDSQSHT-GPSKKPSAPSPLPAGTSWDRGVP (SEQ ID NO:553) of M78076_P11 (SEQ ID NO:172).

The localization of the variant protein was determined according to results from a number of different software programs and analyses, including analyses from SignalP and other specialized programs. The variant protein is believed to be located as follows with regard to the cell: secreted.

Variant protein M78076_P11 (SEQ ID NO:172) also has the following non-silent SNPs (Single Nucleotide Polymorphisms) as listed in Table 151, (given according to their position(s) on the amino acid sequence, with the alternative amino acid(s) listed; the last column indicates whether the SNP is known or not; the presence of known SNPs in variant protein M78076_P11 (SEQ ID NO:172) sequence provides support for the deduced sequence of this variant protein according to the present invention).

TABLE 151

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 214 | G -> | No |
| 214 | G -> R | No |
| 215 | T -> | No |
| 215 | T -> N | No |
| 232 | P -> | No |
| 262 | Q -> | No |
| 309 | G -> E | Yes |
| 370 | Q -> | No |

The glycosylation sites of variant protein M78076_P11 (SEQ ID NO:172), as compared to the known protein Amyloid-like protein 1 precursor (SEQ ID NO:166), are described in Table 152 (given according to their position(s) on the amino acid sequence in the first column; the second column indicates whether the glycosylation site is present in the variant protein; and the last column indicates whether the position is different on the variant protein).

TABLE 152

Glycosylation site(s)

| Position(s) on known amino acid sequence | Present in variant protein? | Position(s) on variant protein |
|---|---|---|
| 337 | Yes | 337 |
| 461 | Yes | 461 |
| 551 | Yes | 551 |

Variant protein M78076_P11(SEQ ID NO:172) is encoded by the following transcript(s): M78076_T11 (SEQ ID NO:118), for which the sequence(s) is/are given at the end of the application. The coding portion of transcript M78076_T11 (SEQ ID NO:1 18) is shown in bold; this coding portion starts at position 139 and ends at position 1995. The transcript also has the following SNPs as listed in Table 153 (given according to their position on the nucleotide sequence, with the alternative nucleic acid listed; the last column indicates whether the SNP is known or not; the presence of known SNPs in variant protein M78076_P11 (SEQ ID NO:172) sequence provides support for the deduced sequence of this variant protein according to the present invention).

TABLE 153

Nucleic acid SNPs

| SNP position(s) on nucleotide sequence | Alternative nucleic acid(s) | Previously known SNP? |
|---|---|---|
| 111 | G -> | No |
| 113 | G -> C | No |
| 113 | G -> T | No |
| 148 | G -> C | Yes |
| 155 | C -> A | Yes |
| 176 | G -> A | Yes |
| 216 | A -> G | Yes |
| 240 | G -> | No |

TABLE 153-continued

Nucleic acid SNPs

| SNP position(s) on nucleotide sequence | Alternative nucleic acid(s) | Previously known SNP? |
|---|---|---|
| 250 | G -> A | Yes |
| 312 | A -> G | Yes |
| 363 | A -> G | Yes |
| 401 | C -> G | Yes |
| 509 | G -> A | Yes |
| 778 | G -> A | No |
| 778 | G -> | No |
| 782 | C -> A | No |
| 782 | C -> | No |
| 832 | C -> | No |
| 924 | G -> | No |
| 1064 | G -> A | Yes |
| 1074 | G -> A | Yes |
| 1248 | G -> | No |
| 1395 | G -> T | Yes |
| 1420 | C -> T | Yes |
| 2005 | G -> A | Yes |
| 2083 | C -> | No |
| 2083 | C -> T | No |
| 2221 | C -> T | Yes |
| 2372 | A -> G | No |
| 2441 | T -> | No |
| 2448 | T -> | No |
| 2515 | C -> T | Yes |

Variant protein M78076_P16 (SEQ ID NO:173) according to the present invention has an amino acid sequence as given at the end of the application; it is encoded by transcript(s) M78076_T18 (SEQ ID NO:121). An alignment is given to the known protein (Amyloid-like protein 1 precursor (SEQ ID NO:166)) at the end of the application. One or more alignments to one or more previously published protein sequences are given at the end of the application. A brief description of the relationship of the variant protein according to the present invention to each such aligned protein is as follows:

1. Comparison Report Between M78076_P16 (SEQ ID NO:173) and APLP1_HUMAN (SEQ ID NO:591):

A. An isolated chimeric polypeptide encoding for M78076_P16 (SEQ ID NO:173), comprising a first amino acid sequence being at least 90% homologous to MGPASPAARGLSRRPGQPPLPLLL-PLLLLLLRAQPAIGSLAGGSPGAAEAPGSAQVAGLCG RLTLHRDLRTGRWEPDPQRSRRCLRD-PQRVLEYCRQMYPELQIARVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNE corresponding to amino acids 1-352 of APLP1_HUMAN (SEQ ID NO:591), which also corresponds to amino acids 1-352 of M78076_P16 (SEQ ID NO:173), and a second amino acid sequence being at least 90% homologous to AERVLLALRRYLRAEQKEQRHTLRHYQH-VAAVDPEKAQQMRFQVHTHLQVIEERVNQS LGLL-DQNPHLAQELRPQIQELLHSEHLGPSE-LEAPAPGGSSEDKGGLQPPDSKDDTPMTLP KGSTEQDAASPEKEKMNPLEQYERKV-NASVPRGFPFHSSEIQRDELAPAGTGVSREAVSG LLIMGAGGGSLIVLSMLLLRRKKPYGA-ISHGVVEVDPMLTLEEQQLRELQRHGYENPTYR FLEERP corresponding to amino acids 406-650 of APLP1_HUMAN (SEQ ID NO:591), which also corresponds to amino acids 353-597 of M78076_P16 (SEQ ID NO:173), wherein said first amino acid sequence and second amino acid sequence are contiguous and in a sequential order.

B. An isolated chimeric polypeptide encoding for an edge portion of M78076_P16 (SEQ ID NO:173), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 352-x to 352; and ending at any of amino acid numbers 353+((n−2)−x), in which x varies from 0 to n−2.

2. Comparison Report Between M78076_P16 (SEQ ID NO:173) and NP_005157 (SEQ ID NO:167):

A. An isolated chimeric polypeptide encoding for M78076_P16 (SEQ ID NO:173), comprising a first amino acid sequence being at least 90% homologous to MGPASPAARGLSRRPGQPPLPLLL-PLLLLLLRAQPAIGSLAGGSPGAAEAPGSAQVAGLCG RLTLHRDLRTGRWEPDPQRSRRCLRD-PQRVLEYCRQMYPELQIARVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNE corresponding to amino acids 1-352 of NP_005157 (SEQ ID NO:167), which also corresponds to amino acids 1-352 of M78076_P16 (SEQ ID NO:173), and a second amino acid sequence being at least 90% homologous to AERVLLALR-RYLRAEQKEQRHTLRHYQHVAAVDPE-KAQQMRFQVHTHLQVIEERVNQS LGLLDQN-PHLAQELRPQIQELLHSEHLGPSELEAPAPGGSSEDKG GLQPPDSKDDTPMTLP KGSTEQDAASPEKEKMN-PLEQYERKVNASVPRGFPFHSSEIQRDE-LAPAGTGVSREAVSG LLIMGAGGGSLIVLSMLLLR-RKKPYGAISHGVVEVDPMLTLEEQQLRELQRHGYEN PTYR FLEERP corresponding to amino acids 406-650 of NP_005157 (SEQ ID NO:167), which also corresponds to amino acids 353-597 of M78076_P16 (SEQ ID NO:173), wherein said first amino acid sequence and second amino acid sequence are contiguous and in a sequential order.

B. An isolated chimeric polypeptide encoding for an edge portion of M78076_P16 (SEQ ID NO:173), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 352-x to 352; and ending at any of amino acid numbers 353+((n−2)−x), in which x varies from 0 to n−2.

The localization of the variant protein was determined according to results from a number of different software programs and analyses, including analyses from SignalP and other specialized programs. The variant protein is believed to be located as follows with regard to the cell: membrane.

Variant protein M78076_P16 (SEQ ID NO:173) also has the following non-silent SNPs (Single Nucleotide Polymorphisms) as listed in Table 154, (given according to their position(s) on the amino acid sequence, with the alternative amino acid(s) listed; the last column indicates whether the SNP is known or not; the presence of known SNPs in variant protein M78076_P16 (SEQ ID NO:173) sequence provides support for the deduced sequence of this variant protein according to the present invention).

TABLE 154

Amino acid mutations

| SNP position(s) on amino acid sequence | Alternative amino acid(s) | Previously known SNP? |
| --- | --- | --- |
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 214 | G -> | No |
| 214 | G -> R | No |
| 215 | T -> | No |
| 215 | T -> N | No |
| 232 | P -> | No |
| 262 | Q -> | No |
| 309 | G -> E | Yes |
| 555 | P -> | No |

The glycosylation sites of variant protein M78076_P16 (SEQ ID NO:173), as compared to the known protein Amyloid-like protein 1 precursor (SEQ ID NO:166), are described in Table 155 (given according to their position(s) on the amino acid sequence in the first column; the second column indicates whether the glycosylation site is present in the variant protein; and the last column indicates whether the position is different on the variant protein).

TABLE 155

Glycosylation site(s)

| Position(s) on known amino acid sequence | Present in variant protein? | Position(s) on variant protein |
| --- | --- | --- |
| 337 | Yes | 337 |
| 408 | Yes | 408 |
| 498 | Yes | 498 |

Variant protein M78076_P16 (SEQ ID NO:173) is encoded by the following transcript(s): M78076_T18 (SEQ ID NO:121), for which the sequence(s) is/are given at the end of the application. The coding portion of transcript M78076_T18 (SEQ ID NO:121) is shown in bold; this coding portion starts at position 139 and ends at position 1929. The transcript also has the following SNPs as listed in Table 156 (given according to their position on the nucleotide sequence, with the alternative nucleic acid listed; the last column indicates whether the SNP is known or not; the presence of known SNPs in variant protein M78076_P16 (SEQ ID NO:173) sequence provides support for the deduced sequence of this variant protein according to the present invention).

TABLE 156

Nucleic acid SNPs

| SNP position(s) on nucleotide sequence | Alternative nucleic acid(s) | Previously known SNP? |
| --- | --- | --- |
| 111 | G -> | No |
| 113 | G -> C | No |
| 113 | G -> T | No |
| 148 | G -> C | Yes |
| 155 | C -> A | Yes |
| 176 | G -> A | Yes |
| 216 | A -> G | Yes |
| 240 | G -> | No |
| 250 | G -> A | Yes |
| 312 | A -> G | Yes |
| 363 | A -> G | Yes |
| 401 | C -> G | Yes |
| 509 | G -> A | Yes |
| 778 | G -> A | No |
| 778 | G -> | No |
| 782 | C -> A | No |
| 782 | C -> | No |
| 832 | C -> | No |
| 924 | G -> | No |
| 1064 | G -> A | Yes |
| 1074 | G -> A | Yes |
| 1236 | G -> T | Yes |
| 1261 | C -> T | Yes |
| 1725 | G -> A | Yes |
| 1803 | C -> | No |
| 1803 | C -> T | No |
| 1941 | C -> T | Yes |
| 2092 | A -> G | No |
| 2161 | T -> | No |
| 2168 | T -> | No |
| 2235 | C -> T | Yes |

Variant protein M78076_P17 (SEQ ID NO:174) according to the present invention has an amino acid sequence as given at the end of the application; it is encoded by transcript(s) M78076_T19 (SEQ ID NO:122). An alignment is given to the known protein (Amyloid-like protein 1 precursor (SEQ ID NO:166)) at the end of the application. One or more alignments to one or more previously published protein sequences are given at the end of the application. A brief description of the relationship of the variant protein according to the present invention to each such aligned protein is as follows:

1. Comparison Report Between M78076_P17 (SEQ ID NO:174) and APLP1_HUMAN (SEQ ID NO:591):

A. An isolated chimeric polypeptide encoding for M78076_P17 (SEQ ID NO:174), comprising a first amino acid sequence being at least 90% homologous to MGPASPAARGLSRRPGQPPLPLLL-PLLLLLLRAQPAIGSLAGGSPGAAEAPGSAQVAGLCG RLTLHRDLRTGRWEPDPQRSRRCLRD-PQRVLEYCRQMYPELQIARVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMR-FQVHTHLQVIEERVNQSLGLLDQNPHLAQELRP QIQELLHSEHLGPSELEAPAPGGSSED-KGGLQPPDSKDDTPMTLPKG corresponding to amino acids 1-526 of APLP1_HUMAN (SEQ ID NO:591), which also corresponds to amino acids 1-526 of M78076_P17 (SEQ ID NO:174), and a second amino acid sequence being at least 70%, optionally at least 80%, preferably at least 85%, more preferably at least 90% and most preferably at least 95% homologous to a polypeptide having the sequence ECVCSKGFPFPLIGDSEG (SEQ ID NO:554) corresponding to amino acids 527-544 of M78076_P17 (SEQ ID NO:174), wherein said first amino acid sequence and second amino acid sequence are contiguous and in a sequential order.

B. An isolated polypeptide encoding for an edge portion of M78076_P17 (SEQ ID NO:174), comprising an amino acid sequence being at least 70%, optionally at least about 80%, preferably at least about 85%, more preferably at least about 90% and most preferably at least about 95% homologous to the sequence ECVCSKGFPFPLIGDSEG (SEQ ID NO:554) of M78076_P17 (SEQ ID NO:174).

2. Comparison Report Between M78076_P17 (SEQ ID NO:174) and NP_005157 (SEQ ID NO:167):

A. An isolated chimeric polypeptide encoding for M78076_P17 (SEQ ID NO:174), comprising a first amino acid sequence being at least 90% homologous to MGPASPAARGLSRRPGQPPLPLLL-PLLLLLLRAQPAIGSLAGGSPGAAEAPGSAQVAGLCG RLTLHRDLRTGRWEPDPQRSRRCLRD-PQRVLEYCRQMYPELQIARVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMR-FQVHTHLQVIEERVNQSLGLLDQNPHLAQELRP QIQELLHSEHLGPSELEAPAPGGSSED-KGGLQPPDSKDDTPMTLPKG corresponding to amino acids 1-526 of NP_005157 (SEQ ID NO:167), which also corresponds to amino acids 1-526 of M78076_P17 (SEQ ID NO:174), and a second amino acid sequence being at least 70%, optionally at least 80%, preferably at least 85%, more preferably at least 90% and most preferably at least 95% homologous to a polypeptide having the sequence ECVCSKGFPFPLIGDSEG (SEQ ID NO:554) corresponding to amino acids 527-544 of M78076_P17 (SEQ ID NO:174), wherein said first amino acid sequence and second amino acid sequence are contiguous and in a sequential order.

B. An isolated polypeptide encoding for an edge portion of M78076_P17 (SEQ ID NO:174), comprising an amino acid sequence being at least 70%, optionally at least about 80%, preferably at least about 85%, more preferably at least about 90% and most preferably at least about 95% homologous to the sequence ECVCSKGFPFPLIGDSEG (SEQ ID NO:554) of M78076_P17 (SEQ ID NO:174).

The localization of the variant protein was determined according to results from a number of different software programs and analyses, including analyses from SignalP and other specialized programs. The variant protein is believed to be located as follows with regard to the cell: secreted.

Variant protein M78076_P17 (SEQ ID NO:174) also has the following non-silent SNPs (Single Nucleotide Polymorphisms) as listed in Table 157, (given according to their position(s) on the amino acid sequence, with the alternative amino acid(s) listed; the last column indicates whether the SNP is known or not; the presence of known SNPs in variant protein M78076_P17 (SEQ ID NO:174) sequence provides support for the deduced sequence of this variant protein according to the present invention).

TABLE 157

Amino acid mutations

| SNP position(s) on amino acid sequence | Alternative amino acid(s) | Previously known SNP? |
| --- | --- | --- |
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 214 | G -> | No |
| 214 | G -> R | No |
| 215 | T -> | No |
| 215 | T -> N | No |
| 232 | P -> | No |
| 262 | Q -> | No |
| 309 | G -> E | Yes |
| 370 | Q -> | No |

The glycosylation sites of variant protein M78076_P17 (SEQ ID NO:174), as compared to the known protein Amyloid-like protein 1 precursor (SEQ ID NO:166), are described in Table 158 (given according to their position(s) on the amino acid sequence in the first column; the second column indicates whether the glycosylation site is present in the variant protein; and the last column indicates whether the position is different on the variant protein).

TABLE 158

Glycosylation site(s)

| Position(s) on known amino acid sequence | Present in variant protein? | Position(s) on variant protein |
| --- | --- | --- |
| 337 | Yes | 337 |
| 461 | Yes | 461 |
| 551 | No | |

Variant protein M78076_P17 (SEQ ID NO:174) is encoded by the following transcript(s): M78076_T19 (SEQ ID NO:122), for which the sequence(s) is/are given at the end of the application. The coding portion of transcript M78076_T19 (SEQ ID NO:122) is shown in bold; this coding portion starts at position 139 and ends at position 1770. The transcript also has the following SNPs as listed in Table 159 (given according to their position on the nucleotide sequence, with the alternative nucleic acid listed; the last column indicates whether the SNP is known or not; the presence of known SNPs in variant protein M78076_P17 (SEQ ID NO:174) sequence provides support for the deduced sequence of this variant protein according to the present invention).

TABLE 159

Nucleic acid SNPs

| SNP position(s) on nucleotide sequence | Alternative nucleic acid(s) | Previously known SNP? |
| --- | --- | --- |
| 111 | G -> | No |
| 113 | G -> C | No |
| 113 | G -> T | No |

TABLE 159-continued

Nucleic acid SNPs

| SNP position(s) on nucleotide sequence | Alternative nucleic acid(s) | Previously known SNP? |
|---|---|---|
| 148 | G -> C | Yes |
| 155 | C -> A | Yes |
| 176 | G -> A | Yes |
| 216 | A -> G | Yes |
| 240 | G -> | No |
| 250 | G -> A | Yes |
| 312 | A -> G | Yes |
| 363 | A -> G | Yes |
| 401 | C -> G | Yes |
| 509 | G -> A | Yes |
| 778 | G -> A | No |
| 778 | G -> | No |
| 782 | C -> A | No |
| 782 | C -> | No |
| 832 | C -> | No |
| 924 | G -> | No |
| 1064 | G -> A | Yes |
| 1074 | G -> A | Yes |
| 1248 | G -> | No |
| 1395 | G -> T | Yes |
| 1420 | C -> T | Yes |
| 1813 | G -> A | Yes |
| 1891 | C -> | No |
| 1891 | C -> T | No |
| 2029 | C -> T | Yes |
| 2180 | A -> G | No |
| 2249 | T -> | No |
| 2256 | T -> | No |
| 2323 | C -> T | Yes |

Variant protein M78076_P22 (SEQ ID NO:175) according to the present invention has an amino acid sequence as given at the end of the application; it is encoded by transcript(s) M78076_T24 (SEQ ID NO:123). An alignment is given to the known protein (Amyloid-like protein 1 precursor (SEQ ID NO:166)) at the end of the application. One or more alignments to one or more previously published protein sequences are given at the end of the application. A brief description of the relationship of the variant protein according to the present invention to each such aligned protein is as follows:

1. Comparison Report Between M78076_P22 (SEQ ID NO:175) and APLP1_HUMAN (SEQ ID NO:591):

A. An isolated chimeric polypeptide encoding for M78076_P22 (SEQ ID NO:175), comprising a first amino acid sequence being at least 90% homologous to MGPASPAARGLSRRPGQPPLPLLL-PLLLLLLRAQPAIGSLAGGSPGAAEAPGSAQVAGLCG RLTLHRDLRTGRWEPDPQRSRRCLRD-PQRVLEYCRQMYPELQIARVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMR-FQVHTHLQVIEERVNQSLGLLDQNPHLAQELRP QI corresponding to amino acids 1-481 of APLP1_HUMAN (SEQ ID NO:591), which also corresponds to amino acids 1-481 of M78076_P22 (SEQ ID NO:175), and a second amino acid sequence being at least 70%, optionally at least 80%, preferably at least 85%, more preferably at least 90% and most preferably at least 95% homologous to a polypeptide having the sequence RECLLPWLPLQISEGRS (SEQ ID NO:555) corresponding to amino acids 482-498 of M78076_P22 (SEQ ID NO:175), wherein said first amino acid sequence and second amino acid sequence are contiguous and in a sequential order.

B. An isolated polypeptide encoding for an edge portion of M78076_P22 (SEQ ID NO:175), comprising an amino acid sequence being at least 70%, optionally at least about 80%, preferably at least about 85%, more preferably at least about 90% and most preferably at least about 95% homologous to the sequence RECLLPWLPLQISEGRS (SEQ ID NO:555) of M78076_P22 (SEQ ID NO:175).

2. Comparison Report Between M78076_P22 (SEQ ID NO:175) and NP_005157 (SEQ ID NO:167):

A. An isolated chimeric polypeptide encoding for M78076_P22 (SEQ ID NO:175), comprising a first amino acid sequence being at least 90% homologous to MGPASPAARGLSRRPGQPPLPLLL-PLLLLLLRAQPAIGSLAGGSPGAAEAPGSAQVAGLCG RLTLHRDLRTGRWEPDPQRSRRCLRD-PQRVLEYCRQMYPELQIARVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMR-FQVHTHLQVIEERVNQSLGLLDQNPHLAQELRP QI corresponding to amino acids 1-481 of NP_005157 (SEQ ID NO:167), which also corresponds to amino acids 1-481 of M78076_P22 (SEQ ID NO:175), and a second amino acid sequence being at least 70%, optionally at least 80%, preferably at least 85%, more preferably at least 90% and most preferably at least 95% homologous to a polypeptide having the sequence RECLLPWLPLQISEGRS (SEQ ID NO:555) corresponding to amino acids 482-498 of M78076_P22 (SEQ ID NO:175), wherein said first amino acid sequence and second amino acid sequence are contiguous and in a sequential order.

B. An isolated polypeptide encoding for an edge portion of M78076_P22 (SEQ ID NO:175), comprising an amino acid sequence being at least 70%, optionally at least about 80%, preferably at least about 85%, more preferably at least about 90% and most preferably at least about 95% homologous to the sequence RECLLPWLPLQISEGRS (SEQ ID NO:555) of M78076_P22 (SEQ ID NO:175).

The localization of the variant protein was determined according to results from a number of different software programs and analyses, including analyses from SignalP and other specialized programs. The variant protein is believed to be located as follows with regard to the cell: secreted.

Variant protein M78076_P22 (SEQ ID NO:175) also has the following non-silent SNPs (Single Nucleotide Polymorphisms) as listed in Table 160, (given according to their position(s) on the amino acid sequence, with the alternative amino acid(s) listed; the last column indicates whether the SNP is known or not; the presence of known SNPs in variant protein M78076_P22 (SEQ ID NO:175) sequence provides support for the deduced sequence of this variant protein according to the present invention).

TABLE 160

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 214 | G -> | No |
| 214 | G -> R | No |
| 215 | T -> | No |
| 215 | T -> N | No |
| 232 | P -> | No |
| 262 | Q -> | No |
| 309 | G -> E | Yes |
| 370 | Q -> | No |

The glycosylation sites of variant protein M78076_P22 (SEQ ID NO:175), as compared to the known protein Amyloid-like protein 1 precursor (SEQ ID NO:166), are described in Table 161 (given according to their position(s) on the amino acid sequence in the first column; the second column indicates whether the glycosylation site is present in the variant protein; and the last column indicates whether the position is different on the variant protein).

TABLE 161

Glycosylation site(s)

| Position(s) on known amino acid sequence | Present in variant protein? | Position(s) on variant protein |
|---|---|---|
| 337 | Yes | 337 |
| 461 | Yes | 461 |
| 551 | No | |

Variant protein M78076_P22 (SEQ ID NO:175) is encoded by the following transcript(s): M78076_T24 (SEQ ID NO:123), for which the sequence(s) is/are given at the end of the application. The coding portion of transcript M78076_T24 (SEQ ID NO:123) is shown in bold; this coding portion starts at position 139 and ends at position 1632. The transcript also has the following SNPs as listed in Table 162 (given according to their position on the nucleotide sequence, with the alternative nucleic acid listed; the last column indicates whether the SNP is known or not; the presence of known SNPs in variant protein M78076_P22 (SEQ ID NO:175) sequence provides support for the deduced sequence of this variant protein according to the present invention).

TABLE 162

Nucleic acid SNPs

| SNP position(s) on nucleotide sequence | Alternative nucleic acid(s) | Previously known SNP? |
|---|---|---|
| 111 | G -> | No |
| 113 | G -> C | No |
| 113 | G -> T | No |
| 148 | G -> C | Yes |
| 155 | C -> A | Yes |

TABLE 162-continued

Nucleic acid SNPs

| SNP position(s) on nucleotide sequence | Alternative nucleic acid(s) | Previously known SNP? |
|---|---|---|
| 176 | G -> A | Yes |
| 216 | A -> G | Yes |
| 240 | G -> | No |
| 250 | G -> A | Yes |
| 312 | A -> G | Yes |
| 363 | A -> G | Yes |
| 401 | C -> G | Yes |
| 509 | G -> A | Yes |
| 778 | G -> A | No |
| 778 | G -> | No |
| 782 | C -> A | No |
| 782 | C -> | No |
| 832 | C -> | No |
| 924 | G -> | No |
| 1064 | G -> A | Yes |
| 1074 | G -> A | Yes |
| 1248 | G -> | No |
| 1395 | G -> T | Yes |
| 1420 | C -> T | Yes |
| 1877 | G -> A | Yes |
| 2112 | T -> G | Yes |
| 2181 | G -> A | Yes |

Variant protein M78076_P23 (SEQ ID NO:176) according to the present invention has an amino acid sequence as given at the end of the application; it is encoded by transcript(s) M78076_T25 (SEQ ID NO:124). An alignment is given to the known protein (Amyloid-like protein 1 precursor (SEQ ID NO:166)) at the end of the application. One or more alignments to one or more previously published protein sequences are given at the end of the application. A brief description of the relationship of the variant protein according to the present invention to each such aligned protein is as follows:

1. Comparison Report Between M78076_P23 (SEQ ID NO:176) and APLP1_HUMAN (SEQ ID NO:591):

A. An isolated chimeric polypeptide encoding for M78076_P23 (SEQ ID NO:176), comprising a first amino acid sequence being at least 90% homologous to MGPASPAARGLSRRPGQPPLPLLL-PLLLLLLRAQPAIGSLAGGSPGAAEAPGSAQVAGLCG RLTLHRDLRTGRWEPDPQRSRRCLRD-PQRVLEYCRQMYPELQIARVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMRFQ corresponding to amino acids 1-448 of APLP1_HUMAN (SEQ ID NO:591), which also corresponds to amino acids 1-448 of M78076_P23 (SEQ ID NO:176), and a second amino acid sequence being at least 70%, optionally at least 80%, preferably at least 85%, more preferably at least 90% and most preferably at least 95% homologous to a polypeptide having the sequence PQNPNSQPRAAGSLEVIISHPFVRRLEI-LISPFQFQNSIPKNSQIVPAASPRGTSSP (SEQ ID NO:556) corresponding to amino acids 449-505 of M78076_P23 (SEQ ID NO:176), wherein said first amino acid sequence and second amino acid sequence are contiguous and in a sequential order.

B. An isolated polypeptide encoding for an edge portion of M78076_P23 (SEQ ID NO:176), comprising an amino acid sequence being at least 70%, optionally at least about 80%, preferably at least about 85%, more preferably at least about 90% and most preferably at least about 95% homologous to the sequence PQNPNSQPRAAGSLEVIISHPFVRRLEI-LISPFQFQNSIPKNSQIVPAASPRGTSSP (SEQ ID NO:556) of M78076_P23 (SEQ ID NO:176).

2. Comparison Report Between M78076_P23 (SEQ ID NO:176) and NP_005157 (SEQ ID NO:167):

A. An isolated chimeric polypeptide encoding for M78076_P23 (SEQ ID NO:176), comprising a first amino acid sequence being at least 90% homologous to MGPASPAARGLSRRPGQPPLPLLL-PLLLLLLRAQPAIGSLAGGSPGAAEAPGSAQVAGLCG RLTLHRDLRTGRWEPDPQRSRRCLRD-PQRVLEYCRQMYPELQIARVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMRFQ corresponding to amino acids 1-448 of NP_005157 (SEQ ID NO:167), which also corresponds to amino acids 1-448 of M78076_P23 (SEQ ID NO:176), and a second amino acid sequence being at least 70%, optionally at least 80%, preferably at least 85%, more preferably at least 90% and most preferably at least 95% homologous to a polypeptide having the sequence PQNPNSQPRAAGSLEVIISHPFVRRLEI-LISPFQFQNSIPKNSQIVPAASPRGTSSP (SEQ ID NO:556) corresponding to amino acids 449-505 of M78076_P23 (SEQ ID NO:176), wherein said first amino acid sequence and second amino acid sequence are contiguous and in a sequential order.

B. An isolated polypeptide encoding for an edge portion of M78076_P23 (SEQ ID NO:176), comprising an amino acid sequence being at least 70%, optionally at least about 80%, preferably at least about 85%, more preferably at least about 90% and most preferably at least about 95% homologous to the sequence PQNPNSQPRAAGSLEVIISHPFVRRLEI-LISPFQFQNSIPKNSQIVPAASPRGTSSP (SEQ ID NO:556) of M78076_P23 (SEQ ID NO:176).

The localization of the variant protein was determined according to results from a number of different software programs and analyses, including analyses from SignalP and other specialized programs. The variant protein is believed to be located as follows with regard to the cell: secreted.

Variant protein M78076_P23 (SEQ ID NO:176) also has the following non-silent SNPs (Single Nucleotide Polymorphisms) as listed in Table 163, (given according to their position(s) on the amino acid sequence, with the alternative amino acid(s) listed; the last column indicates whether the SNP is known or not; the presence of known SNPs in variant protein M78076_P23 (SEQ ID NO:176) sequence provides support for the deduced sequence of this variant protein according to the present invention).

TABLE 163

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 214 | G -> | No |
| 214 | G -> R | No |
| 215 | T -> | No |
| 215 | T -> N | No |
| 232 | P -> | No |
| 262 | Q -> | No |
| 309 | G -> E | Yes |
| 370 | Q -> | No |

The glycosylation sites of variant protein M78076_P23 (SEQ ID NO:176), as compared to the known protein Amyloid-like protein 1 precursor (SEQ ID NO:166), are described in Table 164 (given according to their position(s) on the amino acid sequence in the first column; the second column indicates whether the glycosylation site is present in the variant protein; and the last column indicates whether the position is different on the variant protein).

TABLE 164

Glycosylation site(s)

| Position(s) on known amino acid sequence | Present in variant protein? | Position(s) on variant protein |
|---|---|---|
| 337 | Yes | 337 |
| 461 | No | |
| 551 | No | |

Variant protein M78076_P23 (SEQ ID NO:176) is encoded by the following transcript(s): M78076_T25 (SEQ ID NO:124), for which the sequence(s) is/are given at the end of the application. The coding portion of transcript M78076_T25 (SEQ ID NO:124) is shown in bold; this coding portion starts at position 139 and ends at position 1653. The transcript also has the following SNPs as listed in Table 165 (given according to their position on the nucleotide sequence, with the alternative nucleic acid listed; the last column indicates whether the SNP is known or not; the presence of known SNPs in variant protein M78076_P23 (SEQ ID NO:176) sequence provides support for the deduced sequence of this variant protein according to the present invention).

TABLE 165

Nucleic acid SNPs

| SNP position(s) on nucleotide sequence | Alternative nucleic acid(s) | Previously known SNP? |
|---|---|---|
| 111 | G -> | No |
| 113 | G -> C | No |
| 113 | G -> T | No |
| 148 | G -> C | Yes |
| 155 | C -> A | Yes |
| 176 | G -> A | Yes |
| 216 | A -> G | Yes |
| 240 | G -> | No |
| 250 | G -> A | Yes |

TABLE 165-continued

Nucleic acid SNPs

| SNP position(s) on nucleotide sequence | Alternative nucleic acid(s) | Previously known SNP? |
|---|---|---|
| 312 | A -> G | Yes |
| 363 | A -> G | Yes |
| 401 | C -> G | Yes |
| 509 | G -> A | Yes |
| 778 | G -> A | No |
| 778 | G -> | No |
| 782 | C -> A | No |
| 782 | C -> | No |
| 832 | C -> | No |
| 924 | G -> | No |
| 1064 | G -> A | Yes |
| 1074 | G -> A | Yes |
| 1248 | G -> | No |
| 1395 | G -> T | Yes |
| 1420 | C -> T | Yes |
| 1590 | A -> G | No |
| 1659 | T -> | No |
| 1666 | T -> | No |
| 1733 | C -> T | Yes |

Variant protein M78076_P25 (SEQ ID NO:177) according to the present invention has an amino acid sequence as given at the end of the application; it is encoded by transcript(s) M78076_T27 (SEQ ID NO:125). An alignment is given to the known protein (Amyloid-like protein 1 precursor (SEQ ID NO:166)) at the end of the application. One or more alignments to one or more previously published protein sequences are given at the end of the application. A brief description of the relationship of the variant protein according to the present invention to each such aligned protein is as follows:

1. Comparison Report Between M78076_P25 (SEQ ID NO:177) and APLP1_HUMAN (SEQ ID NO:591):

A. An isolated chimeric polypeptide encoding for M78076_P25 (SEQ ID NO:177), comprising a first amino acid sequence being at least 90% homologous to MGPASPAARGLSRRPGQPPLPLLL-PLLLLLLRAQPAIGSLAGGSPGAAEAPGSAQVAGLCG RLTLHRDLRTGRWEPDPQRSRRCLRD-PQRVLEYCRQMYPELQIARVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMRFQV corresponding to amino acids 1-449 of APLP1_HUMAN (SEQ ID NO:591), which also corresponds to amino acids 1-449 of M78076_P25 (SEQ ID NO:177), and a second amino acid sequence being at least 70%, optionally at least 80%, preferably at least 85%, more preferably at least 90% and most preferably at least 95% homologous to a polypeptide having the sequence LTSFQLPNAPLFLRRPRLRLFSCPLD-PLSVSWTPSYPLNTASLPLPSLSAQLPDPETWTLTCC VFDPCFLALGFLLPPPSILCSVPWIFT-AFPRIVFFFFFFLRQVLALSPRQESSVRSWLIATSTS WVQAILLPQPLE (SEQ ID NO:557) corresponding to amino acids 450-588 of M78076_P25 (SEQ ID NO:177), wherein said first amino acid sequence and second amino acid sequence are contiguous and in a sequential order.

B. An isolated polypeptide encoding for an edge portion of M78076_P25 (SEQ ID NO:177), comprising an amino acid sequence being at least 70%, optionally at least about 80%, preferably at least about 85%, more preferably at least about 90% and most preferably at least about 95% homologous to the sequence LTSFQLPNAPLFLRRPRLRLFSCPLD-PLSVSWTPSYPLNTASLPLPSLSAQLPDPETWTLTCC VFDPCFLALGFLLPPPSILCSVPWIFT-AFPRIVFFFFFFLRQVLALSPRQESSVRSWLIATSTS WVQAILLPQPLE (SEQ ID NO:557) of M78076_P25 (SEQ ID NO:177).

2. Comparison Report Between M78076_P25 (SEQ ID NO:177) and NP_005157 (SEQ ID NO:167):

A. An isolated chimeric polypeptide encoding for M78076_P25 (SEQ ID NO:177), comprising a first amino acid sequence being at least 90% homologous to MGPASPAARGLSRRPGQPPLPLLL-PLLLLLLRAQPAIGSLAGGSPGAAEAPGSAQVAGLCG RLTLHRDLRTGRWEPDPQRSRRCLRD-PQRVLEYCRQMYPELQIARVEQATQAIPMERWC GGSRSGSCAHPHHQVVPFR-CLPGEFVSEALLVPEGCRFLHQERM-DQCESSTRRHQEAQEA CSSQGLILHGSGMLLPCGS-DRFRGVEYVCCPPPGTPDPSGTAVGDPSTRSWPPGSR VEGAE DEEEEESFPQPVDDYFVEP-PQAEEEEETVPPPSSHTLAVVGKVTPT-PRPTDGVDIYFGMPG EISEHEGFLRAKMDLEERRM-RQINEVMREWAMADNQSKNLPKADRQALNEHFQSIL QTL EEQVSGERQRLVETHATRVIALINDQR-RAALEGFLAALQADPPQAERVLLALRRYLRAEQ KEQRHTLRHYQHVAAVDPEKAQQMRFQV corresponding to amino acids 1-449 of NP_005157 (SEQ ID NO:167), which also corresponds to amino acids 1-449 of M78076_P25 (SEQ ID NO:177), and a second amino acid sequence being at least 70%, optionally at least 80%, preferably at least 85%, more preferably at least 90% and most preferably at least 95% homologous to a polypeptide having the sequence LTSFQLPNAPLFLRRPRLRLFSCPLD-PLSVSWTPSYPLNTASLPLPSLSAQLPDPETWTLTCC VFDPCFLALGFLLPPPSILCSVPWIFT-AFPRIVFFFFFFLRQVLALSPRQESSVRSWLIATSTS WVQAILLPQPLE (SEQ ID NO:557) corresponding to amino acids 450-588 of M78076_P25 (SEQ ID NO:177), wherein said first amino acid sequence and second amino acid sequence are contiguous and in a sequential order.

B. An isolated polypeptide encoding for an edge portion of M78076_P25 (SEQ ID NO:177), comprising an amino acid sequence being at least 70%, optionally at least about 80%, preferably at least about 85%, more preferably at least about 90% and most preferably at least about 95% homologous to the sequence LTSFQLPNAPLFLRRPRLRLFSCPLD-PLSVSWTPSYPLNTASLPLPSLSAQLPDPETWTLTCC VFDPCFLALGFLLPPPSILCSVPWIFT-AFPRIVFFFFFFLRQVLALSPRQESSVRSWLIATSTS WVQAILLPQPLE (SEQ ID NO:557) of M78076_P25 (SEQ ID NO:177).

The localization of the variant protein was determined according to results from a number of different software programs and analyses, including analyses from SignalP and other specialized programs. The variant protein is believed to be locates as follows with regard to the cell: membrane.

Variant protein M78076_P25 (SEQ ID NO:177) also has the following non-silent SNPs (Single Nucleotide Polymorphisms) as listed in Table 166, (given according to their position(s) on the amino acid sequence, with the alternative amino acid(s) listed; the last column indicates whether the SNP is known or not; the presence of known SNPs in variant protein M78076_P25 (SEQ ID NO:177) sequence provides support for the deduced sequence of this variant protein according to the present invention).

TABLE 166

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 214 | G -> | No |
| 214 | G -> R | No |
| 215 | T -> | No |
| 215 | T -> N | No |
| 232 | P -> | No |
| 262 | Q -> | No |
| 309 | G -> E | Yes |
| 370 | Q -> | No |
| 520 | A -> S | Yes |
| 546 | F -> | Yes |
| 564 | S -> C | Yes |

The glycosylation sites of variant protein M78076_P25 (SEQ ID NO:177), as compared to the known protein Amyloid-like protein 1 precursor (SEQ ID NO:166), are described in Table 167 (given according to their position(s) on the amino acid sequence in the first column; the second column indicates whether the glycosylation site is present in the variant protein; and the last column indicates whether the position is different on the variant protein).

TABLE 167

Glycosylation site(s)

| Position(s) on known amino acid sequence | Present in variant protein? | Position(s) on variant protein |
|---|---|---|
| 337 | Yes | 337 |
| 461 | No | |
| 551 | No | |

Variant protein M78076_P25 (SEQ ID NO:177) is encoded by the following transcript(s). M78076_T27 (SEQ ID NO:125), for which the sequence(s) is/are given at the end of the application. The coding portion of transcript M78076_T27 (SEQ ID NO:125) is shown in bold; this coding portion starts at position 139 and ends at position 1902. The transcript also has the following SNPs as listed in Table 168 (given according to their position on the nucleotide sequence, with the alternative nucleic acid listed; the last column indicates whether the SNP is known or not; the presence of known SNPs in variant protein M78076_P25 (SEQ ID NO:177) sequence provides support for the deduced sequence of this variant protein according to the present invention).

TABLE 168

Nucleic acid SNPs

| SNP position(s) on nucleotide sequence | Alternative nucleic acid(s) | Previously known SNP? |
|---|---|---|
| 111 | G -> | No |
| 113 | G -> C | No |
| 113 | G -> T | No |
| 148 | G -> C | Yes |
| 155 | C -> A | Yes |
| 176 | G -> A | Yes |
| 216 | A -> G | Yes |
| 240 | G -> | No |
| 250 | G -> A | Yes |
| 312 | A -> G | Yes |
| 363 | A -> G | Yes |
| 401 | C -> G | Yes |
| 509 | G -> A | Yes |
| 778 | G -> A | No |
| 778 | G -> | No |
| 782 | C -> A | No |
| 782 | C -> | No |
| 832 | C -> | No |
| 924 | G -> | No |
| 1064 | G -> A | Yes |
| 1074 | G -> A | Yes |
| 1248 | G -> | No |
| 1395 | G -> T | Yes |
| 1420 | C -> T | Yes |
| 1497 | C -> T | Yes |
| 1696 | G -> T | Yes |
| 1722 | G -> A | Yes |
| 1774 | T -> | Yes |
| 1828 | A -> T | Yes |
| 2271 | A -> G | Yes |
| 2522 | A -> G | Yes |
| 2678 | G -> A | Yes |
| 3524 | G -> A | Yes |
| 3759 | T -> G | Yes |
| 3828 | G -> A | Yes |

As noted above, cluster M78076 features 40 segment(s), which were listed in Table 137 above and for which the sequence(s) are given at the end of the application. These segment(s) are portions of nucleic acid sequence(s) which are described herein separately because they are of particular interest. A description of each segment according to the present invention is now provided.

Segment cluster M78076_N9 (SEQ ID NO:126) according to the present invention is segmented by 79 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 169 below describes the starting and ending position of this segment on each transcript.

TABLE 169

Segment location on transcripts

| Transcript name | Segment starting position | Segment ending position |
|---|---|---|
| M78076_T11 (SEQ ID NO: 118) | 430 | 562 |
| M78076_T12 (SEQ ID NO: 119) | 430 | 562 |
| M78076_T17 (SEQ ID NO: 120) | 430 | 562 |

TABLE 169-continued

Segment location on transcripts

| Transcript name | Segment starting position | Segment ending position |
|---|---|---|
| M78076_T18 (SEQ ID NO: 121) | 430 | 562 |
| M78076_T19 (SEQ ID NO: 122) | 430 | 562 |
| M78076_T24 (SEQ ID NO: 123) | 430 | 562 |
| M78076_T25 (SEQ ID NO: 124) | 430 | 562 |
| M78076_T27 (SEQ ID NO: 125) | 430 | 562 |
| M78076_T5 (SEQ ID NO: 115) | 430 | 562 |
| M78076_T6 (SEQ ID NO: 116) | 430 | 562 |
| M78076_T7 (SEQ ID NO: 117) | 430 | 562 |

Segment cluster M78076_N14 (SEQ ID NO:127) according to the present invention is supported by 81 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 170 below describes the starting and ending position of this segment on each transcript.

TABLE 170

Segment location on transcripts

| Transcript name | Segment starting position | Segment ending position |
|---|---|---|
| M78076_T11 (SEQ ID NO: 118) | 676 | 809 |
| M78076_T12 (SEQ ID NO: 119) | 676 | 809 |
| M78076_T17 (SEQ ID NO: 120) | 676 | 809 |
| M78076_T18 (SEQ ID NO: 121) | 676 | 809 |
| M78076_T19 (SEQ ID NO: 122) | 676 | 809 |
| M78076_T24 (SEQ ID NO: 123) | 676 | 809 |
| M78076_T25 (SEQ ID NO: 124) | 676 | 809 |
| M78076_T27 (SEQ ID NO: 125) | 676 | 809 |
| M78076_T5 (SEQ ID NO: 115) | 676 | 809 |
| M78076_T6 (SEQ ID NO: 116) | 676 | 809 |
| M78076_T7 (SEQ ID NO: 117) | 676 | 809 |

Segment cluster M78076_N21 (SEQ ID NO:128) according to the present invention is supported by 100 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 171 below describes the starting and ending position of this segment on each transcript.

TABLE 171

Segment location on transcripts

| Transcript name | Segment starting position | Segment ending position |
|---|---|---|
| M78076_T11 (SEQ ID NO: 118) | 989 | 1119 |
| M78076_T12 (SEQ ID NO: 119) | 989 | 1119 |

TABLE 171-continued

Segment location on transcripts

| Transcript name | Segment starting position | Segment ending position |
|---|---|---|
| M78076_T17 (SEQ ID NO: 120) | 989 | 1119 |
| M78076_T18 (SEQ ID NO: 121) | 989 | 1119 |
| M78076_T19 (SEQ ID NO: 122) | 989 | 1119 |
| M78076_T24 (SEQ ID NO: 123) | 989 | 1119 |
| M78076_T25 (SEQ ID NO: 124) | 989 | 1119 |
| M78076_T27 (SEQ ID NO: 125) | 989 | 1119 |
| M78076_T5 (SEQ ID NO: 115) | 989 | 1119 |
| M78076_T6 (SEQ ID NO: 116) | 989 | 1119 |
| M78076_T7 (SEQ ID NO: 117) | 989 | 1119 |

Segment cluster M78076_N25 (SEQ ID NO:129) according to the present invention is supported by 107 libraries. The number of libraries was determined as previously described. This segment can be found in the following transcript(s): M78076_T11 (SEQ ID NO:118), 10 M78076_T12 (SEQ ID NO:119), M78076_T17 (SEQ ID NO:120), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 172 below describes the starting and ending position of this segment on each transcript.

TABLE 172

Segment location on transcripts

| Transcript name | Segment starting position | Segment ending position |
|---|---|---|
| M78076_T11 (SEQ ID NO: 118) | 1195 | 1353 |
| M78076_T12 (SEQ ID NO: 119) | 1195 | 1353 |
| M78076_T17 (SEQ ID NO: 120) | 1195 | 1353 |
| M78076_T19 (SEQ ID NO: 122) | 1195 | 1353 |
| M78076_T24 (SEQ ID NO: 123) | 1195 | 1353 |
| M78076_T25 (SEQ ID NO: 124) | 1195 | 1353 |
| M78076_T27 (SEQ ID NO: 125) | 1195 | 1353 |
| M78076_T5 (SEQ ID NO: 115) | 1195 | 1353 |
| M78076_T6 (SEQ ID NO: 116) | 1195 | 1353 |
| M78076_T7 (SEQ ID NO: 117) | 1195 | 1353 |

Segment cluster M78076_N27 (SEQ ID NO:130) according to the present invention is supported by 98 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO: 116) and M78076_T7 (SEQ ID NO:117). Table 173 below describes the starting and ending position of this segment on each transcript.

TABLE 173

Segment location on transcripts

| Transcript name | Segment starting position | Segment ending position |
|---|---|---|
| M78076_T11 (SEQ ID NO: 118) | 1354 | 1482 |
| M78076_T12 (SEQ ID NO: 119) | 1354 | 1482 |
| M78076_T17 (SEQ ID NO: 120) | 1354 | 1482 |

TABLE 173-continued

Segment location on transcripts

| Transcript name | Segment starting position | Segment ending position |
|---|---|---|
| M78076_T18 (SEQ ID NO: 121) | 1195 | 1323 |
| M78076_T19 (SEQ ID NO: 122) | 1354 | 1482 |
| M78076_T24 (SEQ ID NO: 123) | 1354 | 1482 |
| M78076_T25 (SEQ ID NO: 124) | 1354 | 1482 |
| M78076_T27 (SEQ ID NO: 125) | 1354 | 1482 |
| M78076_T5 (SEQ ID NO: 115) | 1354 | 1482 |
| M78076_T6 (SEQ ID NO: 116) | 1354 | 1482 |
| M78076_T7 (SEQ ID NO: 117) | 1354 | 1482 |

Segment cluster M78076_N29 (SEQ ID NO:131) according to the present invention is supported by 2 libraries. The number of libraries was determined as previously described. This segment can be found in the following transcript(s): M78076_T27 (SEQ ID NO:125). Table 174 below describes the starting and ending position of this segment on each transcript.

TABLE 174

Segment location on transcripts

| Transcript name | Segment starting position | Segment ending position |
|---|---|---|
| M78076_T27 (SEQ ID NO: 125) | 1487 | 3129 |

Segment cluster M78076_N32 (SEQ ID NO:132) according to the present invention is supported by 2 libraries. The number of libraries was determined as previously described. This segment can be found in the following transcript(s): M78076_T24 (SEQ ID NO:123) and M78076_T27 (SEQ ID NO:125). Table 175 below describes the starting and ending position of this segment on each transcript.

TABLE 175

Segment location on transcripts

| Transcript name | Segment starting position | Segment ending position |
|---|---|---|
| M78076_T24 (SEQ ID NO: 123) | 1583 | 2454 |
| M78076_T27 (SEQ ID NO: 125) | 3230 | 4101 |

Segment cluster M78076_N35 (SEQ ID NO:133) according to the present invention is supported by 4 libraries. The number of libraries was determined as previously described. This segment can be found in the following transcript(s): M78076_T12 (SEQ ID NO:119) and M78076_T5 (SEQ ID NO:115). Table 176 below describes the starting and ending position of this segment on each transcript.

TABLE 176

Segment location on transcripts

| Transcript name | Segment starting position | Segment ending position |
|---|---|---|
| M78076_T12 (SEQ ID NO: 119) | 1691 | 1946 |
| M78076_T5 (SEQ ID NO: 115) | 1691 | 1946 |

Segment cluster M78076_N38 (SEQ ID NO:134) according to the present invention is supported by 10 libraries. The number of libraries was determined as previously described. This segment can be found in the following transcript(s): M78076_T12 (SEQ ID NO:119), M78076_T17 (SEQ ID NO:120) and M78076_T7 (SEQ ID NO:117). Table 177 below describes the starting and ending position of this segment on each transcript.

TABLE 177

Segment location on transcripts

| Transcript name | Segment starting position | Segment ending position |
|---|---|---|
| M78076_T12 (SEQ ID NO: 119) | 1974 | 2436 |
| M78076_T17 (SEQ ID NO: 120) | 1715 | 2177 |
| M78076_T7 (SEQ ID NO: 117) | 1715 | 2177 |

Segment cluster M78076_N42 (SEQ ID NO:135) according to the present invention is supported by 3 libraries. The number of libraries was determined as previously described. This segment can be found in the following transcript(s): M78076_T17 (SEQ ID NO:120). Table 178 below describes the starting and ending position of this segment on each transcript.

TABLE 178

Segment location on transcripts

| Transcript name | Segment starting position | Segment ending position |
|---|---|---|
| M78076_T17 (SEQ ID NO: 120) | 2261 | 2495 |

Segment cluster M78076_N44 (SEQ ID NO:136) according to the present invention is supported by 3 libraries. The number of libraries was determined as previously described. This segment can be found in the following transcript(s): M78076_T11 (SEQ ID NO:118). Table 179 below describes the starting and ending position of this segment on each transcript.

TABLE 179

Segment location on transcripts

| Transcript name | Segment starting position | Segment ending position |
|---|---|---|
| M78076_T11 (SEQ ID NO: 118) | 1849 | 1969 |

Segment cluster M78076_N45 (SEQ ID NO:137) according to the present invention is supported by 158 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T5 (SEQ ID NO:115), M78076_T6 (SEQ ID NO:116) and M78076_T7 (SEQ ID NO:117). Table 180 below describes the starting and ending position of this segment on each transcript.

TABLE 180

Segment location on transcripts

| Transcript name | Segment starting position | Segment ending position |
|---|---|---|
| M78076_T11 (SEQ ID NO: 118) | 1970 | 2113 |
| M78076_T12 (SEQ ID NO: 119) | 2583 | 2726 |
| M78076_T17 (SEQ ID NO: 120) | 2559 | 2702 |
| M78076_T18 (SEQ ID NO: 121) | 1690 | 1833 |
| M78076_T19 (SEQ ID NO: 122) | 1778 | 1921 |
| M78076_T5 (SEQ ID NO: 115) | 2108 | 2251 |
| M78076_T6 (SEQ ID NO: 116) | 1861 | 2004 |
| M78076_T7 (SEQ ID NO: 117) | 2324 | 2467 |

Segment cluster M78076_N52 (SEQ ID NO:138) according to the present invention is supported by 139 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T25 (SEQ ID NO:124), M78076_T5 (SEQ ID NO:115), M78076_T6 (SEQ ID NO:116) and M78076_T7 (SEQ ID NO:117). Table 181 below describes the starting and ending position of this segment on each transcript.

TABLE 181

Segment location on transcripts

| Transcript name | Segment starting position | Segment ending position |
|---|---|---|
| M78076_T11 (SEQ ID NO: 118) | 2271 | 2568 |
| M78076_T12 (SEQ ID NO: 119) | 2884 | 3181 |
| M78076_T17 (SEQ ID NO: 120) | 2860 | 3157 |
| M78076_T18 (SEQ ID NO: 121) | 1991 | 2288 |
| M78076_T19 (SEQ ID NO: 122) | 2079 | 2376 |
| M78076_T25 (SEQ ID NO: 124) | 1489 | 1786 |
| M78076_T5 (SEQ ID NO: 115) | 2409 | 2706 |
| M78076_T6 (SEQ ID NO: 116) | 2162 | 2459 |
| M78076_T7 (SEQ ID NO: 117) | 2625 | 2922 |

According to an optional embodiment of the present invention, short segments related to the above cluster are also provided. These segments are up to about 120 bp in length, and so are included in a separate description.

Segment cluster M78076_N0 (SEQ ID NO:139) according to the present invention is supported by 42 libraries. The number of libraries was determined as previously described. This segment can be found in the following transcript(s): M78076_T11 (SEQ ED NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 182 below describes the starting and ending position of this segment on each transcript.

TABLE 182

Segment location on transcripts

| Transcript name | Segment starting position | Segment ending position |
|---|---|---|
| M78076_T11 (SEQ ID NO: 118) | 1 | 116 |
| M78076_T12 (SEQ ID NO: 119) | 1 | 116 |
| M78076_T17 (SEQ ID NO: 120) | 1 | 116 |
| M78076_T18 (SEQ ID NO: 121) | 1 | 116 |
| M78076_T19 (SEQ ID NO: 122) | 1 | 116 |
| M78076_T24 (SEQ ID NO: 123) | 1 | 116 |
| M78076_T25 (SEQ ID NO: 124) | 1 | 116 |
| M78076_T27 (SEQ ID NO: 125) | 1 | 116 |
| M78076_T5 (SEQ ID NO: 115) | 1 | 116 |
| M78076_T6 (SEQ ID NO: 116) | 1 | 116 |
| M78076_T7 (SEQ ID NO: 117) | 1 | 116 |

Segment cluster M78076_N1 (SEQ ID NO:140) according to the present invention is supported by 55 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 183 below describes the starting and ending position of this segment on each transcript.

TABLE 183

Segment location on transcripts

| Transcript name | Segment starting position | Segment ending position |
|---|---|---|
| M78076_T11 (SEQ ID NO: 118) | 117 | 157 |
| M78076_T12 (SEQ ID NO: 119) | 117 | 157 |
| M78076_T17 (SEQ ID NO: 120) | 117 | 157 |
| M78076_T18 (SEQ ID NO: 121) | 117 | 157 |
| M78076_T19 (SEQ ID NO: 122) | 117 | 157 |
| M78076_T24 (SEQ ID NO: 123) | 117 | 157 |
| M78076_T25 (SEQ ID NO: 124) | 117 | 157 |
| M78076_T27 (SEQ ID NO: 125) | 117 | 157 |
| M78076_T5 (SEQ ID NO: 115) | 117 | 157 |
| M78076_T6 (SEQ ID NO: 116) | 117 | 157 |
| M78076_T7 (SEQ ID NO: 117) | 117 | 157 |

Segment cluster M78076_N2 (SEQ ID NO:141) according to the present invention is supported by 56 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 184 below describes the starting and ending position of this segment on each transcript.

TABLE 184

Segment location on transcripts

| Transcript name | Segment starting position | Segment ending position |
|---|---|---|
| M78076_T11 (SEQ ID NO: 118) | 158 | 201 |
| M78076_T12 (SEQ ID NO: 119) | 158 | 201 |
| M78076_T17 (SEQ ID NO: 120) | 158 | 201 |
| M78076_T18 (SEQ ID NO: 121) | 158 | 201 |
| M78076_T19 (SEQ ID NO: 122) | 158 | 201 |
| M78076_T24 (SEQ ID NO: 123) | 158 | 201 |
| M78076_T25 (SEQ ID NO: 124) | 158 | 201 |
| M78076_T27 (SEQ ID NO: 125) | 158 | 201 |
| M78076_T5 (SEQ ID NO: 115) | 158 | 201 |
| M78076_T6 (SEQ ID NO: 116) | 158 | 201 |
| M78076_T7 (SEQ ID NO: 117) | 158 | 201 |

Segment cluster M78076_N3 (SEQ ID NO:142) according to the present invention is supported by 60 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 185 below describes the starting and ending position of this segment on each transcript.

TABLE 185

Segment location on transcripts

| Transcript name | Segment starting position | Segment ending position |
|---|---|---|
| M78076_T11 (SEQ ID NO: 118) | 202 | 285 |
| M78076_T12 (SEQ ID NO: 119) | 202 | 285 |
| M78076_T17 (SEQ ID NO: 120) | 202 | 285 |
| M78076_T18 (SEQ ID NO: 121) | 202 | 285 |
| M78076_T19 (SEQ ID NO: 122) | 202 | 285 |
| M78076_T24 (SEQ ID NO: 123) | 202 | 285 |
| M78076_T25 (SEQ ID NO: 124) | 202 | 285 |
| M78076_T27 (SEQ ID NO: 125) | 202 | 285 |
| M78076_T5 (SEQ ID NO: 115) | 202 | 285 |
| M78076_T6 (SEQ ID NO: 116) | 202 | 285 |
| M78076_T7 (SEQ ID NO: 117) | 202 | 285 |

Segment cluster M78076_N5 (SEQ ID NO:143) according to the present invention is supported by 68 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 186 below describes the starting and

TABLE 186

Segment location on transcripts

| Transcript name | Segment starting position | Segment ending position |
|---|---|---|
| M78076_T11 (SEQ ID NO: 118) | 286 | 367 |
| M78076_T12 (SEQ ID NO: 119) | 286 | 367 |
| M78076_T17 (SEQ ID NO: 120) | 286 | 367 |
| M78076_T18 (SEQ ID NO: 121) | 286 | 367 |
| M78076_T19 (SEQ ID NO: 122) | 286 | 367 |
| M78076_T24 (SEQ ID NO: 123) | 286 | 367 |
| M78076_T25 (SEQ ID NO: 124) | 286 | 367 |
| M78076_T27 (SEQ ID NO: 125) | 286 | 367 |
| M78076_T5 (SEQ ID NO: 115) | 286 | 367 |
| M78076_T6 (SEQ ID NO: 116) | 286 | 367 |
| M78076_T7 (SEQ ID NO: 117) | 286 | 367 |

Segment cluster M78076_N6 (SEQ ID NO:144) according to the present invention is supported by 73 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 187 below describes the starting and ending position of this segment on each transcript.

TABLE 187

Segment location on transcripts

| Transcript name | Segment starting position | Segment ending position |
|---|---|---|
| M78076_T11 (SEQ ID NO: 118) | 368 | 429 |
| M78076_T12 (SEQ ID NO: 119) | 368 | 429 |
| M78076_T17 (SEQ ID NO: 120) | 368 | 429 |
| M78076_T18 (SEQ ID NO: 121) | 368 | 429 |
| M78076_T19 (SEQ ID NO: 122) | 368 | 429 |
| M78076_T24 (SEQ ID NO: 123) | 368 | 429 |
| M78076_T25 (SEQ ID NO: 124) | 368 | 429 |
| M78076_T27 (SEQ ID NO: 125) | 368 | 429 |
| M78076_T5 (SEQ ID NO: 115) | 368 | 429 |
| M78076_T6 (SEQ ID NO: 116) | 368 | 429 |
| M78076_T7 (SEQ ID NO: 117) | 368 | 429 |

Segment cluster M78076_N1I (SEQ ID NO:145) according to the present invention is supported by 68 libraries. The number of libraries was determined as previously described. This segment can be found in the following transcript(s): M78076_T 11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 188 below describes the starting and ending position of this segment on each transcript.

TABLE 188

Segment location on transcripts

| Transcript name | Segment starting position | Segment ending position |
|---|---|---|
| M78076_T11 (SEQ ID NO: 118) | 563 | 578 |
| M78076_T12 (SEQ ID NO: 119) | 563 | 578 |
| M78076_T17 (SEQ ID NO: 120) | 563 | 578 |
| M78076_T18 (SEQ ID NO: 121) | 563 | 578 |
| M78076_T19 (SEQ ID NO: 122) | 563 | 578 |
| M78076_T24 (SEQ ID NO: 123) | 563 | 578 |
| M78076_T25 (SEQ ID NO: 124) | 563 | 578 |
| M78076_T27 (SEQ ID NO: 125) | 563 | 578 |
| M78076_T5 (SEQ ID NO: 115) | 563 | 578 |
| M78076_T6 (SEQ ID NO: 116) | 563 | 578 |
| M78076_T7 (SEQ ID NO: 117) | 563 | 578 |

Segment cluster M78076_N12 (SEQ ID NO:146) according to the present invention is supported by 76 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 189 below describes the starting and ending position of this segment on each transcript.

TABLE 189

Segment location on transcripts

| Transcript name | Segment starting position | Segment ending position |
|---|---|---|
| M78076_T11 (SEQ ID NO: 118) | 579 | 675 |
| M78076_T12 (SEQ ID NO: 119) | 579 | 675 |
| M78076_T17 (SEQ ID NO: 120) | 579 | 675 |
| M78076_T18 (SEQ ID NO: 121) | 579 | 675 |
| M78076_T19 (SEQ ID NO: 122) | 579 | 675 |
| M78076_T24 (SEQ ID NO: 123) | 579 | 675 |
| M78076_T25 (SEQ ID NO: 124) | 579 | 675 |
| M78076_T27 (SEQ ID NO: 125) | 579 | 675 |
| M78076_T5 (SEQ ID NO: 115) | 579 | 675 |
| M78076_T6 (SEQ ID NO: 116) | 579 | 675 |
| M78076_T7 (SEQ ID NO: 117) | 579 | 675 |

Segment cluster M78076_N17 (SEQ ID NO:147) according to the present invention is supported by 73 libraries. The number of libraries was determined as previously described. This segment can be found in the following transcript(s): M78076_Ti1 (SEQ ID NO:118), M78076_T12 (SEQ ID NO:119), M78076_T17 (SEQ ID NO:120),. M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 190 below describes the starting and ending position of this segment on each transcript.

TABLE 190

Segment location on transcripts

| Transcript name | Segment starting position | Segment ending position |
|---|---|---|
| M78076_T11 (SEQ ID NO: 118) | 810 | 867 |
| M78076_T12 (SEQ ID NO: 119) | 810 | 867 |
| M78076_T17 (SEQ ID NO: 120) | 810 | 867 |
| M78076_T18 (SEQ ID NO: 121) | 810 | 867 |
| M78076_T19 (SEQ ID NO: 122) | 810 | 867 |
| M78076_T24 (SEQ ID NO: 123) | 810 | 867 |
| M78076_T25 (SEQ ID NO: 124) | 810 | 867 |
| M78076_T27 (SEQ ID NO: 125) | 810 | 867 |
| M78076_T5 (SEQ ID NO: 115) | 810 | 867 |
| M78076_T6 (SEQ ID NO: 116) | 810 | 867 |
| M78076_T7 (SEQ ID NO: 117) | 810 | 867 |

Segment cluster M78076_N18 (SEQ ID NO:148) according to the present invention is supported by 88 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 191 below describes the starting and ending position of this segment on each transcript.

TABLE 191

Segment location on transcripts

| Transcript name | Segment starting position | Segment ending position |
|---|---|---|
| M78076_T11 (SEQ ID NO: 118) | 868 | 924 |
| M78076_T12 (SEQ ID NO: 119) | 868 | 924 |
| M78076_T17 (SEQ ID NO: 120) | 868 | 924 |
| M78076_T18 (SEQ ID NO: 121) | 868 | 924 |
| M78076_T19 (SEQ ID NO: 122) | 868 | 924 |
| M78076_T24 (SEQ ID NO: 123) | 868 | 924 |
| M78076_T25 (SEQ ID NO: 124) | 868 | 924 |
| M78076_T27 (SEQ ID NO: 125) | 868 | 924 |
| M78076_T5 (SEQ ID NO: 115) | 868 | 924 |
| M78076_T6 (SEQ ID NO: 116) | 868 | 924 |
| M78076_T7 (SEQ ID NO: 117) | 868 | 924 |

Segment cluster M78076_N19 (SEQ ID NO:149) according to the present invention is supported by 91 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 192 below describes the starting and ending position of this segment on each transcript.

TABLE 192

Segment location on transcripts

| Transcript name | Segment starting position | Segment ending position |
|---|---|---|
| M78076_T11 (SEQ ID NO: 118) | 925 | 988 |
| M78076_T12 (SEQ ID NO: 119) | 925 | 988 |
| M78076_T17 (SEQ ID NO: 120) | 925 | 988 |
| M78076_T18 (SEQ ID NO: 121) | 925 | 988 |
| M78076_T19 (SEQ ID NO: 122) | 925 | 988 |
| M78076_T24 (SEQ ID NO: 123) | 925 | 988 |
| M78076_T25 (SEQ ID NO: 124) | 925 | 988 |
| M78076_T27 (SEQ ID NO: 125) | 925 | 988 |
| M78076_T5 (SEQ ID NO: 115) | 925 | 988 |
| M78076_T6 (SEQ ID NO: 116) | 925 | 988 |
| M78076_T7 (SEQ ID NO: 117) | 925 | 988 |

Segment cluster M78076_N23 (SEQ ID NO:150) according to the present invention is supported by 91 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T25 (SEQ ID NO:124), M78076_T27 (SEQ ID NO:125), M78076_T5 (SEQ ID NO:115), M78076_T6 (SEQ ID NO:116) and M78076_T7 (SEQ ID NO:117). Table 193 below describes the starting and ending position of this segment on each transcript.

TABLE 193

Segment location on transcripts

| Transcript name | Segment starting position | Segment ending position |
|---|---|---|
| M78076_T11 (SEQ ID NO: 118) | 1120 | 1194 |
| M78076_T12 (SEQ ID NO: 119) | 1120 | 1194 |
| M78076_T17 (SEQ ID NO: 120) | 1120 | 1194 |
| M78076_T18 (SEQ ID NO: 121) | 1120 | 1194 |
| M78076_T19 (SEQ ID NO: 122) | 1120 | 1194 |
| M78076_T24 (SEQ ID NO: 123) | 1120 | 1194 |
| M78076_T25 (SEQ ID NO: 124) | 1120 | 1194 |
| M78076_T27 (SEQ ID NO: 125) | 1120 | 1194 |
| M78076_T5 (SEQ ID NO: 115) | 1120 | 1194 |
| M78076_T6 (SEQ ID NO: 116) | 1120 | 1194 |
| M78076_T7 (SEQ ID NO: 117) | 1120 | 1194 |

Segment cluster M78076_N28 (SEQ ID NO:151) according to the present invention is supported by 3 libraries. The number of libraries was determined as previously described. This segment can be found in the following transcript(s): M78076_T27 (SEQ ID NO:125). Table 194 below describes the starting and ending position of this segment on each transcript.

TABLE 194

Segment location on transcripts

| Transcript name | Segment starting position | Segment ending position |
|---|---|---|
| M78076_T27 (SEQ ID NO: 125) | 1483 | 1486 |

Segment cluster M78076_N30 (SEQ ID NO:152) according to the present invention is supported by 91 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T27 (SEQ ID NO:125), M78076_T5 (SEQ ID NO:115), M78076_T6 (SEQ ID NO:116) and M78076_T7 (SEQ ID NO:117). Table 195 below describes the starting and ending position of this segment on each transcript.

TABLE 195

Segment location on transcripts

| Transcript name | Segment starting position | Segment ending position |
|---|---|---|
| M78076_T11 (SEQ ID NO: 118) | 1483 | 1554 |
| M78076_T12 (SEQ ID NO: 119) | 1483 | 1554 |
| M78076_T17 (SEQ ID NO: 120) | 1483 | 1554 |
| M78076_T18 (SEQ ID NO: 121) | 1324 | 1395 |
| M78076_T19 (SEQ ID NO: 122) | 1483 | 1554 |
| M78076_T24 (SEQ ID NO: 123) | 1483 | 1554 |
| M78076_T27 (SEQ ID NO: 125) | 3130 | 3201 |
| M78076_T5 (SEQ ID NO: 115) | 1483 | 1554 |
| M78076_T6 (SEQ ID NO: 116) | 1483 | 1554 |
| M78076_T7 (SEQ ID NO: 117) | 1483 | 1554 |

Segment cluster M78076_N31 (SEQ ID NO:153) according to the present invention is supported by 87 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T24 (SEQ ID NO:123), M78076_T27 (SEQ ID NO:125), M78076_T5 (SEQ ID NO:115), M78076_T6 (SEQ ID NO:116) and M78076_T7 (SEQ ID NO:117). Table 196 below describes the starting and ending position of this segment on each transcript.

TABLE 196

Segment location on transcripts

| Transcript name | Segment starting position | Segment ending position |
|---|---|---|
| M78076_T11 (SEQ ID NO: 118) | 1555 | 1582 |
| M78076_T12 (SEQ ID NO: 119) | 1555 | 1582 |
| M78076_T17 (SEQ ID NO: 120) | 1555 | 1582 |
| M78076_T18 (SEQ ID NO: 121) | 1396 | 1423 |
| M78076_T19 (SEQ ID NO: 122) | 1555 | 1582 |
| M78076_T24 (SEQ ID NO: 123) | 1555 | 1582 |
| M78076_T27 (SEQ ID NO: 125) | 3202 | 3229 |
| M78076_T5 (SEQ ID NO: 115) | 1555 | 1582 |
| M78076_T6 (SEQ ID NO: 116) | 1555 | 1582 |
| M78076_T7 (SEQ ID NO: 117) | 1555 | 1582 |

Segment cluster M78076_N34 (SEQ ID NO:154) according to the present invention is supported by 102 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T5 (SEQ ID NO:115), M78076_T6 (SEQ ID NO:116) and M78076_T7 (SEQ ID NO:117). Table 197 below describes the starting and ending position of this segment on each transcript.

TABLE 197

Segment location on transcripts

| Transcript name | Segment starting position | Segment ending position |
|---|---|---|
| M78076_T11 (SEQ ID NO: 118) | 1583 | 1690 |
| M78076_T12 (SEQ ID NO: 119) | 1583 | 1690 |
| M78076_T17 (SEQ ID NO: 120) | 1583 | 1690 |
| M78076_T18 (SEQ ID NO: 121) | 1424 | 1531 |
| M78076_T19 (SEQ ID NO: 122) | 1583 | 1690 |
| M78076_T5 (SEQ ID NO: 115) | 1583 | 1690 |
| M78076_T6 (SEQ ID NO: 116) | 1583 | 1690 |
| M78076_T7 (SEQ ID NO: 117) | 1583 | 1690 |

Segment cluster M78076_N36 (SEQ ID NO:155) according to the present invention is supported by 32 libraries. The number of libraries was determined as previously described. This segment can be found in the following transcript(s): M78076_T12 (SEQ ID NO:119) and M78076_T5 (SEQ ID NO:115). Table 198 below describes the starting and ending position of this segment on each transcript.

TABLE 198

Segment location on transcripts

| Transcript name | Segment starting position | Segment ending position |
|---|---|---|
| M78076_T12 (SEQ ID NO: 119) | 1947 | 1949 |
| M78076_T5 (SEQ ID NO: 115) | 1947 | 1949 |

Segment cluster M78076_N37 (SEQ ID NO:156) according to the present invention is supported by 91 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T5 (SEQ ID NO:115), M78076_T6 (SEQ ID NO:116) and M78076_T7 (SEQ ID NO:117). Table 199 below describes the starting and ending position of this segment on each transcript.

TABLE 199

Segment location on transcripts

| Transcript name | Segment starting position | Segment ending position |
|---|---|---|
| M78076_T11 (SEQ ID NO: 118) | 1691 | 1714 |
| M78076_T12 (SEQ ID NO: 119) | 1950 | 1973 |
| M78076_T17 (SEQ ID NO: 120) | 1691 | 1714 |
| M78076_T18 (SEQ ID NO: 121) | 1532 | 1555 |
| M78076_T19 (SEQ ID NO: 122) | 1691 | 1714 |
| M78076_T5 (SEQ ID NO: 115) | 1950 | 1973 |
| M78076_T6 (SEQ ID NO: 116) | 1691 | 1714 |
| M78076_T7 (SEQ ID NO: 117) | 1691 | 1714 |

Segment cluster M78076_N39 (SEQ ID NO:157) according to the present invention is supported by 6 libraries. The number of libraries was determined as previously described. This segment can be found in the following transcript(s): M78076_T12 (SEQ ID NO:119), M78076_T17 (SEQ ID NO:120), M78076_T6 (SEQ ID NO:116) and M78076_T7 (SEQ ID NO:117). Table 200 below describes the starting and ending position of this segment on each transcript.

TABLE 200

Segment location on transcripts

| Transcript name | Segment starting position | Segment ending position |
|---|---|---|
| M78076_T12 (SEQ ID NO: 119) | 2437 | 2448 |
| M78076_T17 (SEQ ID NO: 120) | 2178 | 2189 |
| M78076_T6 (SEQ ID NO: 116) | 1715 | 1726 |
| M78076_T7 (SEQ ID NO: 117) | 2178 | 2189 |

Segment cluster M78076_N40 (SEQ ID NO:158) according to the present invention is supported by 102 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID 5 NO:121), M78076_T5 (SEQ ID NO:115), M78076_T6 (SEQ ID NO:116) and M78076_T7 (SEQ ID NO:117). Table 201 below describes the starting and ending position of this segment on each transcript.

TABLE 201

Segment location on transcripts

| Transcript name | Segment starting position | Segment ending position |
|---|---|---|
| M78076_T11 (SEQ ID NO: 118) | 1715 | 1723 |
| M78076_T12 (SEQ ID NO: 119) | 2449 | 2457 |
| M78076_T17 (SEQ ID NO: 120) | 2190 | 2198 |
| M78076_T18 (SEQ ID NO: 121) | 1556 | 1564 |
| M78076_T5 (SEQ ID NO: 115) | 1974 | 1982 |
| M78076_T6 (SEQ ID NO: 116) | 1727 | 1735 |
| M78076_T7 (SEQ ID NO: 117) | 2190 | 2198 |

Segment cluster M78076_N41 (SEQ ID NO:159) according to the present invention is supported by 112 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T5 (SEQ ID NO:115), M78076_T6 (SEQ ID NO:116) and M78076_T7 (SEQ ID NO:117). Table 202 below describes the starting and ending position of this segment on each transcript.

TABLE 202

Segment location on transcripts

| Transcript name | Segment starting position | Segment ending position |
|---|---|---|
| M78076_T11 (SEQ ID NO: 118) | 1724 | 1785 |
| M78076_T12 (SEQ ID NO: 119) | 2458 | 2519 |
| M78076_T17 (SEQ ID NO: 120) | 2199 | 2260 |
| M78076_T18 (SEQ ID NO: 121) | 1565 | 1626 |
| M78076_T5 (SEQ ID NO: 115) | 1983 | 2044 |
| M78076_T6 (SEQ ID NO: 116) | 1736 | 1797 |
| M78076_T7 (SEQ ID NO: 117) | 2199 | 2260 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 203.

TABLE 203

Oligonucleotides related to this segment

| Oligonucleotide name | Overexpressed in cancers | Chip reference |
|---|---|---|
| M78076_0_7_0 (SEQ ID NO: 515) | lung malignant tumors | LUN |
| M78076_0_7_0 (SEQ ID NO: 515) | breast malignant tumors | BRS |

The sequence of M78076_0_7_0 (SEQ ID NO:515) oligonucleotide is: GAGAAGATGAACCCGCTGGAACAGTATGAGCGAAAGGTGAATGCGTCTGT Segment cluster M78076_N43 (SEQ ID NO:160) according to the present invention is supported by 134 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T5 (SEQ ID NO:115), M78076_T6 (SEQ ID NO:116) and M78076_T7 (SEQ ID NO:117). Table 204 below describes the starting and ending position of this segment on each transcript.

TABLE 204

Segment location on transcripts

| Transcript name | Segment starting position | Segment ending position |
|---|---|---|
| M78076_T11 (SEQ ID NO: 118) | 1786 | 1848 |
| M78076_T12 (SEQ ID NO: 119) | 2520 | 2582 |
| M78076_T17 (SEQ ID NO: 120) | 2496 | 2558 |
| M78076_T18 (SEQ ID NO: 121) | 1627 | 1689 |
| M78076_T19 (SEQ ID NO: 122) | 1715 | 1777 |
| M78076_T5 (SEQ ID NO: 115) | 2045 | 2107 |
| M78076_T6 (SEQ ID NO: 116) | 1798 | 1860 |
| M78076_T7 (SEQ ID NO: 117) | 2261 | 2323 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 205.

TABLE 205

Oligonucleotides related to this segment

| Oligonucleotide name | Overexpressed in cancers | Chip reference |
|---|---|---|
| M78076_0_7_0 (SEQ ID NO: 515) | lung malignant tumors | LUN |
| M78076_0_7_0 (SEQ ID NO: 515) | breast malignant tumors | BRS |

The sequence of M78076_0_7_0 (SEQ ID NO:515) oligonucleotide is:

GAGAAGATGAACCCGCTGGAACAGTATGAGCGAAAGGTGAATGCGTCTGT

Segment cluster M78076_N47 (SEQ ID NO:161) according to the present invention is supported by 130 libraries. The number of libraries was determined as previously described. This 10 segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T5 (SEQ ID NO:115), M78076_T6 (SEQ ID NO:116) and M78076_T7 (SEQ ID NO:117). Table 206 below describes the starting and ending position of this segment on each transcript.

TABLE 206

Segment location on transcripts

| Transcript name | Segment starting position | Segment ending position |
|---|---|---|
| M78076_T11 (SEQ ID NO: 118) | 2114 | 2149 |
| M78076_T12 (SEQ ID NO: 119) | 2727 | 2762 |
| M78076_T17 (SEQ ID NO: 120) | 2703 | 2738 |
| M78076_T18 (SEQ ID NO: 121) | 1834 | 1869 |
| M78076_T19 (SEQ ID NO: 122) | 1922 | 1957 |
| M78076_T5 (SEQ ID NO: 115) | 2252 | 2287 |
| M78076_T6 (SEQ ID NO: 116) | 2005 | 2040 |
| M78076_T7 (SEQ ID NO: 117) | 2468 | 2503 |

Segment cluster M78076_N48 (SEQ ID NO: 162) according to the present invention is supported by 126 libraries. The number of libraries was determined as previously described. This segment can be found in the following transcript(s): M78076_T11 (SEQ ID NO:118), M78076_T12 (SEQ ED NO:119), M78076_T17 (SEQ ID NO:120), M78076_T18 (SEQ ID NO:121), M78076_T19 (SEQ ID NO:122), M78076_T5 (SEQ ID NO:115), M78076_T6 (SEQ ID NO:116) and M78076_T7 (SEQ ED NO:117). Table 207 below describes the starting and ending position of this segment on each transcript.

TABLE 207

Segment location on transcripts

| Transcript name | Segment starting position | Segment ending position |
|---|---|---|
| M78076_T11 (SEQ ID NO: 118) | 2150 | 2188 |
| M78076_T12 (SEQ ID NO: 119) | 2763 | 2801 |
| M78076_T17 (SEQ ID NO: 120) | 2739 | 2777 |
| M78076_T18 (SEQ ID NO: 121) | 1870 | 1908 |
| M78076_T19 (SEQ ID NO: 122) | 1958 | 1996 |
| M78076_T5 (SEQ ID NO: 115) | 2288 | 2326 |
| M78076_T6 (SEQ ID NO: 116) | 2041 | 2079 |
| M78076_T7 (SEQ ID NO: 117) | 2504 | 2542 |

Segment cluster M78076_N49 (SEQ ID NO:163) according to the present invention is supported by 127 libraries. The number of libraries was determined as previously described. This segment can be found in the following transcript(s): M78076_T11 (SEQ ID NO:118), M78076_T12 (SEQ ID NO:119), M78076_T17 (SEQ if) NO:120), M78076_T18 (SEQ ID NO:121), M78076_T19 (SEQ ID NO:122), M78076_T5 (SEQ ID NO:115), M78076_T6 (SEQ ID NO:116) and M78076_T7 (SEQ ID NO:117). Table 208 below describes the starting and ending

TABLE 208

Segment location on transcripts

| Transcript name | Segment starting position | Segment ending position |
|---|---|---|
| M78076_T11 (SEQ ID NO: 118) | 2189 | 2247 |
| M78076_T12 (SEQ ID NO: 119) | 2802 | 2860 |
| M78076_T17 (SEQ ID NO: 120) | 2778 | 2836 |

TABLE 208-continued

| | Segment location on transcripts | |
|---|---|---|
| Transcript name | Segment starting position | Segment ending position |
| M78076_T18 (SEQ ID NO: 121) | 1909 | 1967 |
| M78076_T19 (SEQ ID NO: 122) | 1997 | 2055 |
| M78076_T5 (SEQ ID NO: 115) | 2327 | 2385 |
| M78076_T6 (SEQ ID NO: 116) | 2080 | 2138 |
| M78076_T7 (SEQ ID NO: 117) | 2543 | 2601 |

Segment cluster M78076_N50 (SEQ ID NO:164) according to the present invention is supported by 121 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO: 121), M78076_T19 (SEQ ID NO:122), M78076_T5 (SEQ ID NO: 115), M78076_T6 (SEQ ID NO:116) and M78076_T7 (SEQ ID NO:117). Table 209 below describes the starting and ending position of this segment on each transcript.

TABLE 209

| | Segment location on transcripts | |
|---|---|---|
| Transcript name | Segment starting position | Segment ending position |
| M78076_T11 (SEQ ID NO: 118) | 2248 | 2264 |
| M78076_T12 (SEQ ID NO: 119) | 2861 | 2877 |
| M78076_T17 (SEQ ID NO: 120) | 2837 | 2853 |
| M78076_T18 (SEQ ID NO: 121) | 1968 | 1984 |
| M78076_T19 (SEQ ID NO: 122) | 2056 | 2072 |
| M78076_T5 (SEQ ID NO: 115) | 2386 | 2402 |
| M78076_T6 (SEQ ID NO: 116) | 2139 | 2155 |
| M78076_T7 (SEQ ID NO: 117) | 2602 | 2618 |

Segment cluster M78076_N51 (SEQ ID NO:165) according to the present invention is supported by 123 libraries. The number of libraries was determined as previously described. This segment can be found in the following transcript(s): M78076_T11 (SEQ ID NO:118), M78076_T12 (SEQ ID NO:119), M78076_T17 (SEQ ID NO:120), M78076_T18 (SEQ ID NO:121), M78076_T19 (SEQ ID NO:122), M78076_T25 (SEQ ID NO:124), M78076_T5 (SEQ ID NO:115), M78076_T6 (SEQ ID NO:116) and M78076_T7 (SEQ ID NO:117). Table 210 below describes the starting and ending position of this segment on each transcript.

TABLE 210

| | Segment location on transcripts | |
|---|---|---|
| Transcript name | Segment starting position | Segment ending position |
| M78076_T11 (SEQ ID NO: 118) | 2265 | 2270 |
| M78076_T12 (SEQ ID NO: 119) | 2878 | 2883 |
| M78076_T17 (SEQ ID NO: 120) | 2854 | 2859 |
| M78076_T18 (SEQ ID NO: 121) | 1985 | 1990 |
| M78076_T19 (SEQ ID NO: 122) | 2073 | 2078 |
| M78076_T25 (SEQ ID NO: 124) | 1483 | 1488 |
| M78076_T5 (SEQ ID NO: 115) | 2403 | 2408 |
| M78076_T6 (SEQ ID NO: 116) | 2156 | 2161 |
| M78076_T7 (SEQ ID NO: 117) | 2619 | 2624 |

The alignment of M78076 variant proteins to the previously known proteins is shown in the attached CD-Rom.

Expression of Amyloid-like protein 1 M78076 transcripts which are detectable by amplicon as depicted in sequence name M78076Junc 36-45-47 (SEQ ID NO:475) in normal and cancerous lung tissues:

Expression of Amyloid-like protein 1 transcripts detectable by or according to Junc 36-45-47-M78076Junc 36-45-47 (SEQ ID NO:475) amplicon and primers M78076Junc 36-45-47F (SEQ ID NO:473) M78076Junc 36-45-47R (SEQ ID NO:474) was measured by real time PCR in a lung tissue panel (see table 2_4 above). In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), Ubiquitin (GenBank Accession No. BC000449 (SEQ ID NO:458); amplicon—Ubiquitin-amplicon (SEQ ID NO:461)) and SDHA (GenBank Accession No. NM_004168 (SEQ ID NO:462); amplicon—SDHA-amplicon (SEQ ID NO:465)) was measured similarly. The results are shown in FIG. 14.

Figure 14:
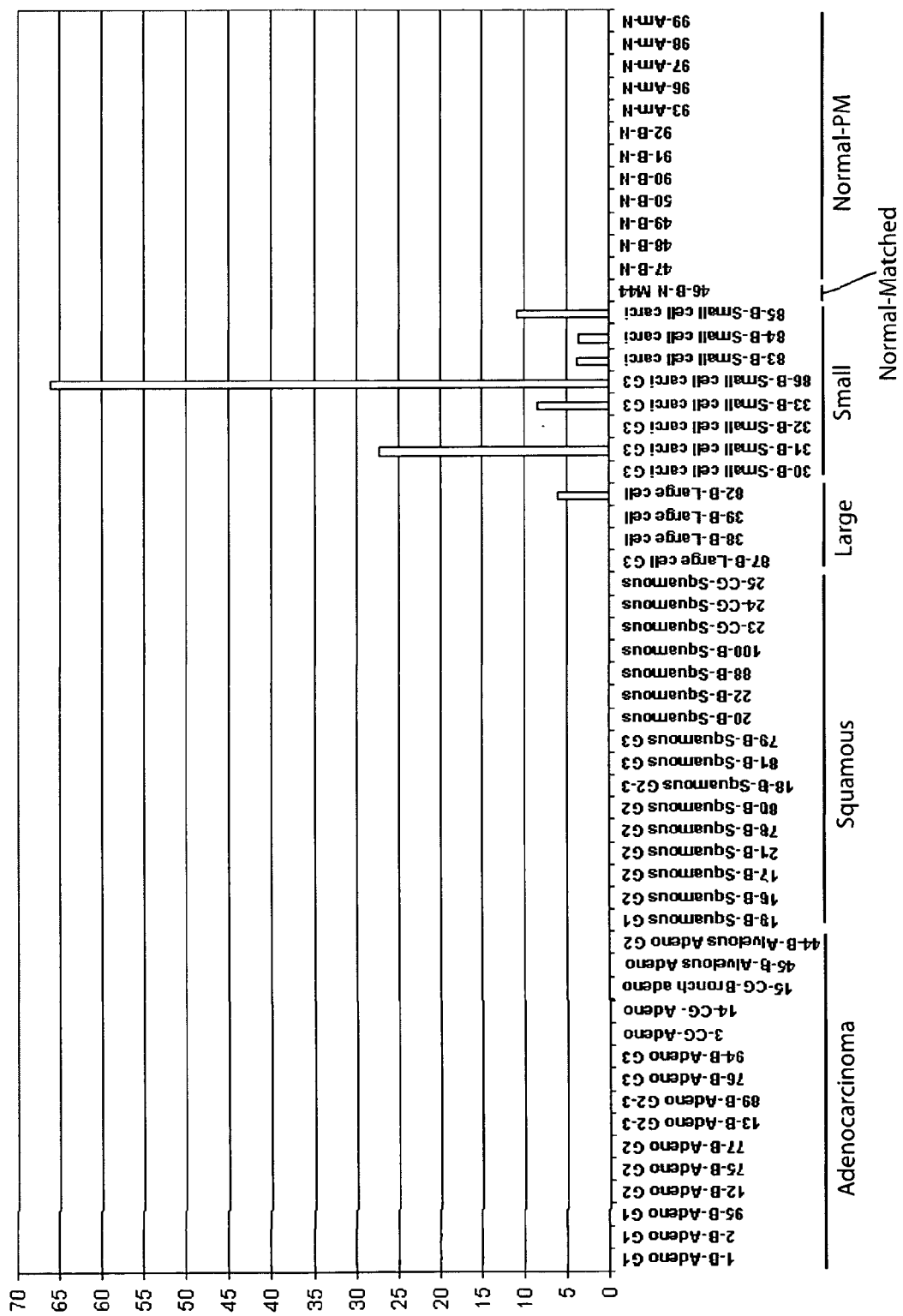
FIG. 14 is a histogram showing expression of Amyloid-like protein 1 M78076 transcripts which are detectable by amplicon as depicted in sequence name M78076Junc 36-45-47 in normal and cancerous lung tissues.

As is evident from FIG. 14, Amyloid-like protein 1 transcripts detectable by the above amplicon were detected only in 6 small cell carcinoma samples and in 1 large cell carcinoma sample.

Primer pairs are also optionally and preferably encompassed within the present invention; for example, for the above experiment, the following primer pair was used as a non-limiting illustrative example only of a suitable primer pair: M78076Junc 36-45-47F (SEQ ID NO:473) forward primer; and M78076Junc 36-45-47R (SEQ ID NO:474) reverse primer.

The present invention also preferably encompasses any amplicon obtained through the use of any suitable primer pair; for example, for the above experiment, the following amplicon was obtained as a non-limiting illustrative example only of a suitable amplicon: M78076Junc 36-45-47 (SEQ ID NO:475).

```
Primers:
Forward primer M78076Junc 36-45-47F (SEQ ID NO: 473):
CATGACCCTTCCAAAAGGTGAA Reverse primer M78076Junc 36-45-47R (SEQ ID NO: 474):
CATGATCAGCAGACCCGACA Amplicon M78076Junc 36-45-47 (SEQ ID NO: 475):
CATGACCCTTCCAAAAGGTGAATGCGTCTGTTCCAAGGGGTTTCCCTTTCCACTCATC

GGAGATTCAGAGGGATGAGCTGGCACCAGCTGGGACAGGGGTGTCCCGTGAGGCTGT

GTCGGGTCTGCTGATCATG
```

The conversion of the M78076Junc 36-45-47 (SEQ ID NO:475) name to the currently available sequence version, as listed in Table 137, is as follows: M78076Junc 37-43-45.

Expression of Amyloid-like protein 1 M78076 transcripts which are detectable by amplicon as depicted in sequence name M78076seg32 (SEQ ID NO:478) in normal and cancerous lung tissues:

Expression of Amyloid-like protein 1 transcripts detectable by or according to seg32—M78076seg32 (SEQ ID NO:478) amplicon and primers M78076seg32F2 (SEQ ID NO:476) M78076seg32R2 (SEQ ID NO:477) was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), Ubiquitin (GenBank Accession No. BC000449 (SEQ ID NO:458); amplicon—Ubiquitin-amplicon (SEQ ID NO:461)) and SDHA (GenBank Accession No. NM_004168 (SEQ ID NO:462); amplicon—SDHA-amplicon (SEQ ID NO:465)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2_4, above, "Tissue samples in lung cancer testing panel"), to obtain a value of fold up-regulation for each sample relative to median of the normal PM samples.

Figure 15A:
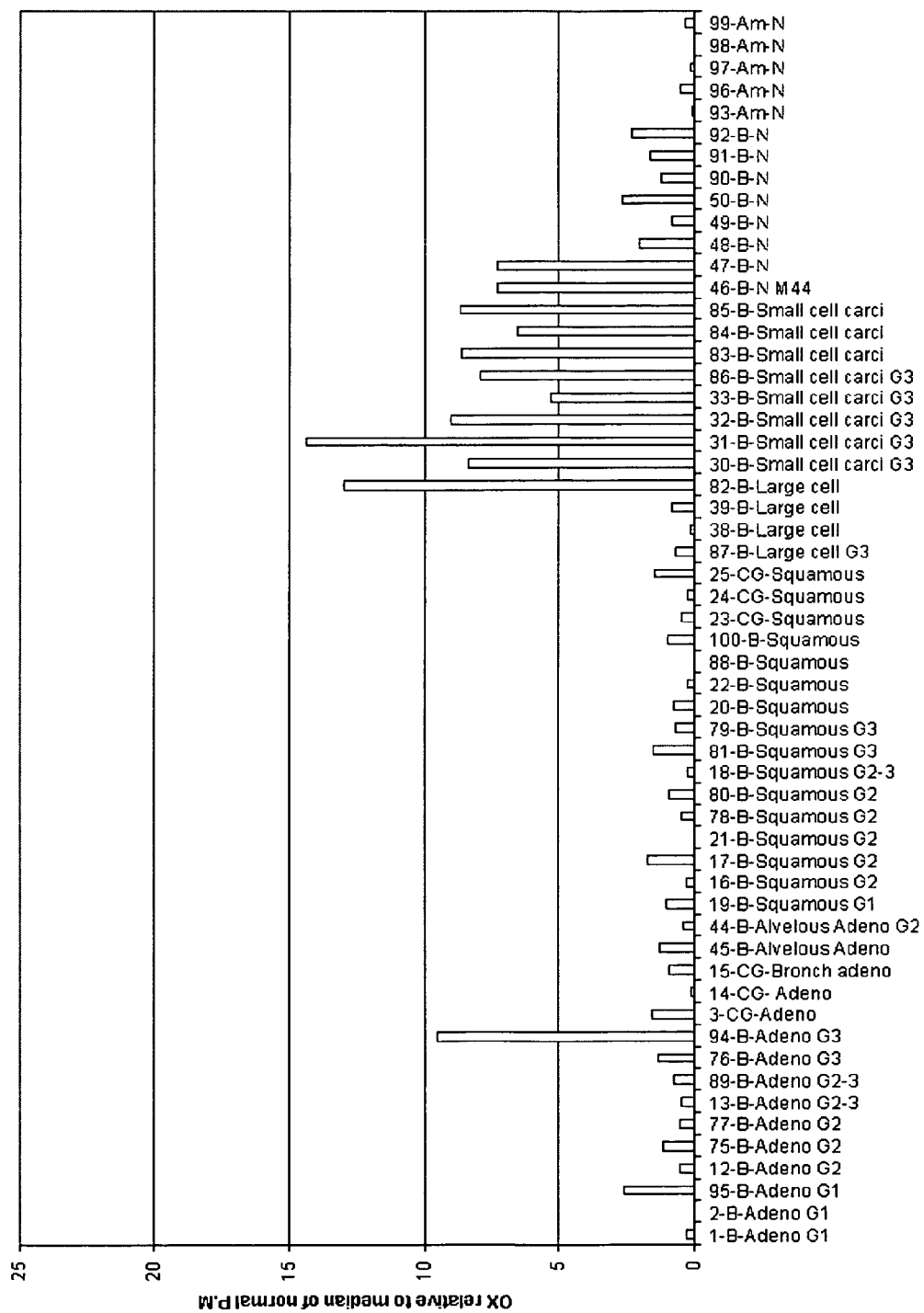
FIG. 15A is a histogram showing expression of Amyloid-like protein 1 M78076 transcripts which are detectable by amplicon as depicted in sequence name M78076seg32 in normal and cancerous lung tissues.

FIG. 15A is a histogram showing over expression of the above-indicated Amyloid-like protein 1 transcripts in cancerous lung samples relative to the normal samples.

As is evident from FIG. 15A, the expression of Amyloid-like protein 1 transcripts detectable by the above amplicon in cancer samples was significantly higher than in the non-cancerous samples (Sample Nos. 46-50, 90-93, 96-99 Table 2_4, "Tissue samples in lung cancer testing panel"). Notably an over-expression of at least 5 fold was found in 8 out of 8 small cells carcinoma samples.

Statistical analysis was applied to verify the significance of these results, as described below.

The P value for the difference in the expression levels of Amyloid-like protein 1 transcripts detectable by the above amplicon in lung cancer samples versus the normal tissue samples was determined by T test as 1.26E-06.

Threshold of 5 fold overexpression was found to differentiate between cancer and normal samples with P value of 7.14E-05 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: M78076seg32F2 (SEQ ID NO:476) forward primer; and M78076seg32R2 (SEQ ID NO:477) reverse primer.

The present invention also preferably encompasses any amplicon obtained through the use of any suitable primer pair; for example, for the above experiment, the following amplicon was obtained as a non-limiting illustrative example only of a suitable amplicon: M78076seg32 (SEQ ID NO:478).

```
Primers:
Forward primer M78076seg32F2 (SEQ ID NO: 476):
ACCCTGGCTCCCATTACAGA Reverse primer M78076seg32R2 (SEQ ID NO: 477):
GACCGGATGGCAGAATCATG Amplicon M78076seg32 (SEQ ID NO: 478):
ACCCTGGCTCCCATTACAGATCTCTGAGGGCAGATCTTGACTCCTAAATGTTGGGCCC

CCCCAATTTCATTTATTCCTCTATAACAAACAGCCCAGACCTTAGCAGTGAAAATCAA

CAATGATTTTCTTTGTTCATGATTCTGCCATCCGGTC
```

Expression of Homo sapiens amyloid beta (A4) precursor-like protein 1 (APLP1) M78076 transcripts which are detectable by amplicon as depicted in sequence name M78076 seg32 in different normal tissues:

Expression of Homo sapiens amyloid beta (A4) precursor-like protein 1 (APLP1) transcripts detectable by or according to M78076 seg32 amplicon (SEQ ID NO:478) and primers: M78076 seg32F2 (SEQ ID NO:476) and M78076 seg32R2 (SEQ ID NO:477) was measured by real time PCR. In parallel the expression of four housekeeping genes—RPL19 (GenBank Accession No. NM_000981; RPL19 amplicon), TATA box (GenBank Accession No. NM_003194; TATA amplicon), Ubiquitin (GenBank Accession No. BC000449; amplicon—Ubiquitin-amplicon) and SDHA (GenBank Accession No. NM_004168; amplicon—SDHA-amplicon) was measured similarly. For each RT sample, the expression of the above amplicon was normalized to the geometric mean of the quantities of the housekeeping genes. The normalized quantity of each RT sample was then divided by the median of the quantities of the Lung samples (Sample Nos. 15-17 Table 2_6), to obtain a value of relative expression of each sample relative to median of the Lung samples.

Primers:
Forward primer M78076 seg32F2 (SEQ ID NO: 476):
ACCCTGGCTCCCATTACAGA

Reverse primer M78076 seg32R2 (SEQ ID NO: 477):
GACCGGATGGCAGAATCATG

Amplicon M78076 seg32 (SEQ ID NO: 478):
ACCCTGGCTCCCATTACAGATCTCTGAGGGCAGATCTTGACTCCTAAATGTTGGGCCC

CCCCAATTTCATTTATTCCTCTATAACAAACAGCCCAGACCTTAGCAGTGAAAATCAA

CAATGATTTTTCTTTGTTCATGATTCTGCCATCCGGTC

FIG. 15B is a histogram showing expression of Homo sapiens amyloid beta (A4) precursor-like protein 1 (APLP1) M78076 transcripts which are detectable by amplicon as depicted in sequence name M78076 seg32 in different normal tissues.

Expression of Amyloid-like protein 1 M78076 transcripts which are detectable by amplicon as depicted in sequence name M78076seg46 (SEQ ID NO:481) in normal and cancerous lung tissues:

Expression of Amyloid-like protein 1 transcripts detectable by or according to seg46—M78076seg46 (SEQ ID NO:481) amplicon and primers M78076seg46F (SEQ ID NO:479) M78076seg46R (SEQ ID NO:480) was measured by real time PCR. In parallel the expression of four housekeeping genes -PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), Ubiquitin (GenBank Accession No. BC000449 (SEQ ID NO:458); amplicon—Ubiquitin-amplicon (SEQ ID NO:461)) and SDHA (GenBank Accession No. NM_004168 (SEQ ID NO:462); amplicon—SDHA-amplicon (SEQ ID NO:465)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2_4, above, "Tissue samples in lung cancer testing panel"), to obtain a value of fold up-regulation for each sample relative to median of the normal PM samples.

Figure 16A:
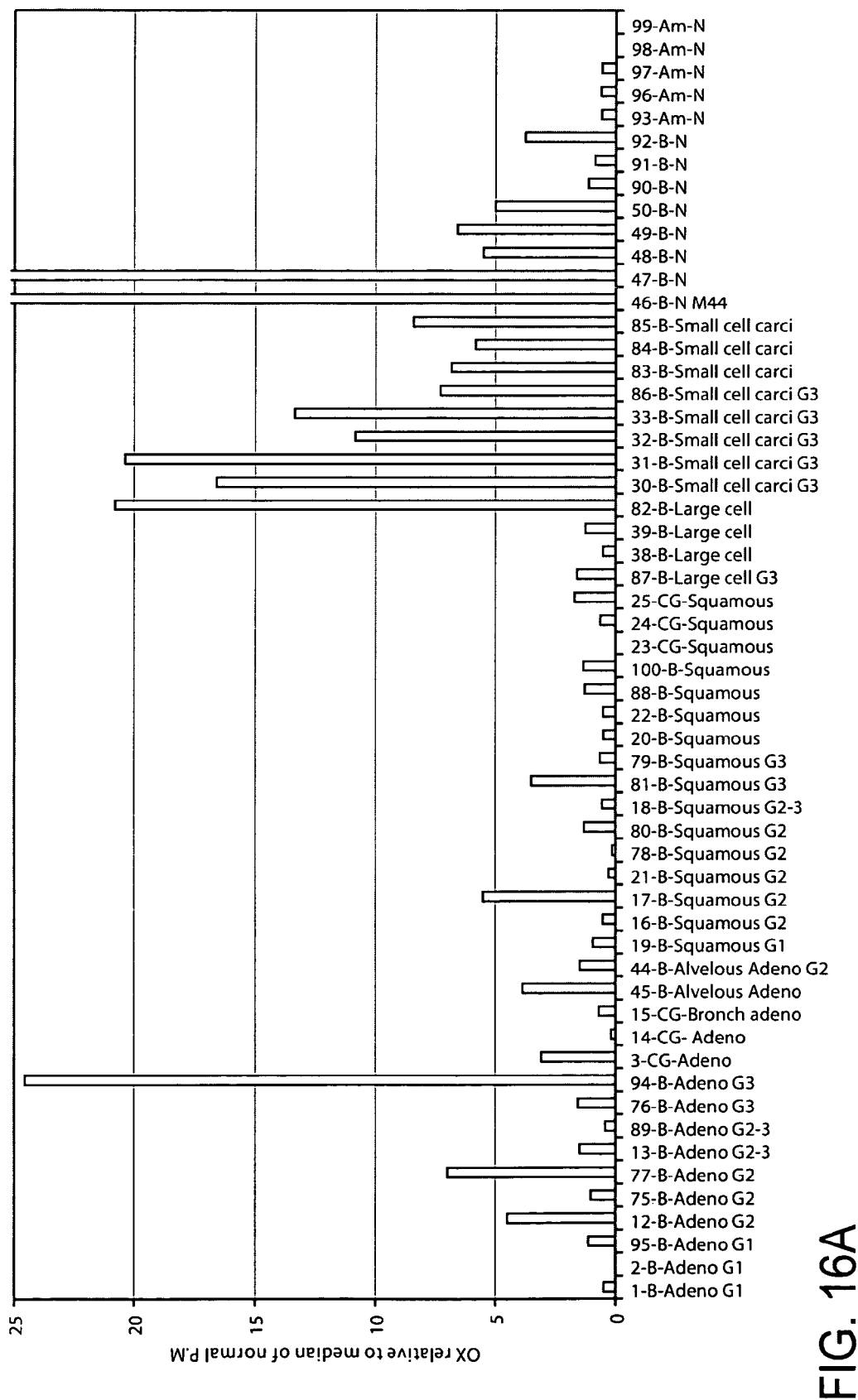
FIG. 16A is a histogram showing expression of Amyloid-like protein 1 M78076 transcripts which are detectable by amplicon as depicted in sequence name M78076seg46 in normal and cancerous lung tissues.

FIG. 16A is a histogram showing over expression of the above-indicated Amyloid-like protein 1 transcripts in cancerous lung samples relative to the normal samples.

As is evident from FIG. 16A the expression of Amyloid-like protein 1 transcripts detectable by the above amplicon in cancer samples was significantly higher than in the non-cancerous samples (Sample Nos. 46-50, 90-93, 96-99 Table 2_4, "Tissue samples in lung cancer testing panel"). Notably an over-expression of at least 5 fold was found in 8 out of 8 small cell carcinoma samples.

Statistical analysis was applied to verify the significance of these results, as described below.

Threshold of 5 fold overexpression was found to differentiate between cancer and normal samples with P value of 1.3 1E-03 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: M78076seg46F (SEQ ID NO:479) forward primer; and M78076seg46R (SEQ ID NO:480) reverse primer.

The present invention also preferably encompasses any amplicon obtained through the use of any suitable primer pair; for example, for the above experiment, the following amplicon was obtained as a non-limiting illustrative example only of a suitable amplicon: M78076seg46 (SEQ ID NO:481).

Primers:
Forward primer M78076seg46F (SEQ ID NO: 479):
GAACAGCCGGGTACCTAGGG

Reverse primer M78076seg46R (SEQ ID NO: 480):
GGCTTCTTTGAGGGTCCTGTG

Amplicon M78076seg46 (SEQ ID NO: 481):
GAACAGCCGGGTACCTAGGGGAAGAGACCAGAGGTCAGCGGCCAGGCTGTGATTCCC

AAAGCCACACAGGACCCTCAAAGAAGCC

The conversion of the M78076seg46 (SEQ ID NO:481) name to the currently available sequence version, as listed in Table 137, is as follows: M78076seg44.

Expression of Homo sapiens amyloid beta (A4) precursor-like protein 1 (APLP1) M78076 transcripts which are detectable by amplicon as depicted in sequence name M78076 seg46 (SEQ ID NO:481) in different normal tissues Expression of Homo sapiens amyloid beta (A4) precursor-like protein 1 (APLP1) transcripts detectable by or according to M78076 seg46 amplicon (SEQ ID NO:481) and primers: M78076 seg46F (SEQ ID NO:479) and M78076 seg46R (SEQ ID NO:480) was measured by real time PCR. In parallel the expression of four housekeeping genes -RPL19 (GenBank Accession No. NM_000981; RPL19 amplicon), TATA box (GenBank Accession No. NM_003194; TATA amplicon), Ubiquitin (GenBank Accession No. BC000449; amplicon—Ubiquitin-amplicon) and SDHA (GenBank Accession No. NM_004168; amplicon—SDHA-amplicon) was measured similarly. For each RT sample, the expression of the above amplicon was normalized to the geometric mean of the quantities of the housekeeping genes. The normalized quantity of each RT sample was then divided by the median of the quantities of the lung samples (Sample Nos. 15-17 Table 2_6), to obtain a value of relative expression of each sample relative to median of the Lung samples.

```
Primers:
Forward primer M78076 seg46F:
GAACAGCCGGGTACCTAGGG

Reverse primer M78076 seg46R:
GGCTTCTTTGAGGGTCCTGTG

Amplicon M78076 seg46:
GAACAGCCGGGTACCTAGGGGAAGAGACCAGAGGTCAGCGGCCAGGCTGTGATTCCC

AAAGCCACACAGGACCCTCAAAGAAGCC
```

Figure 16B:
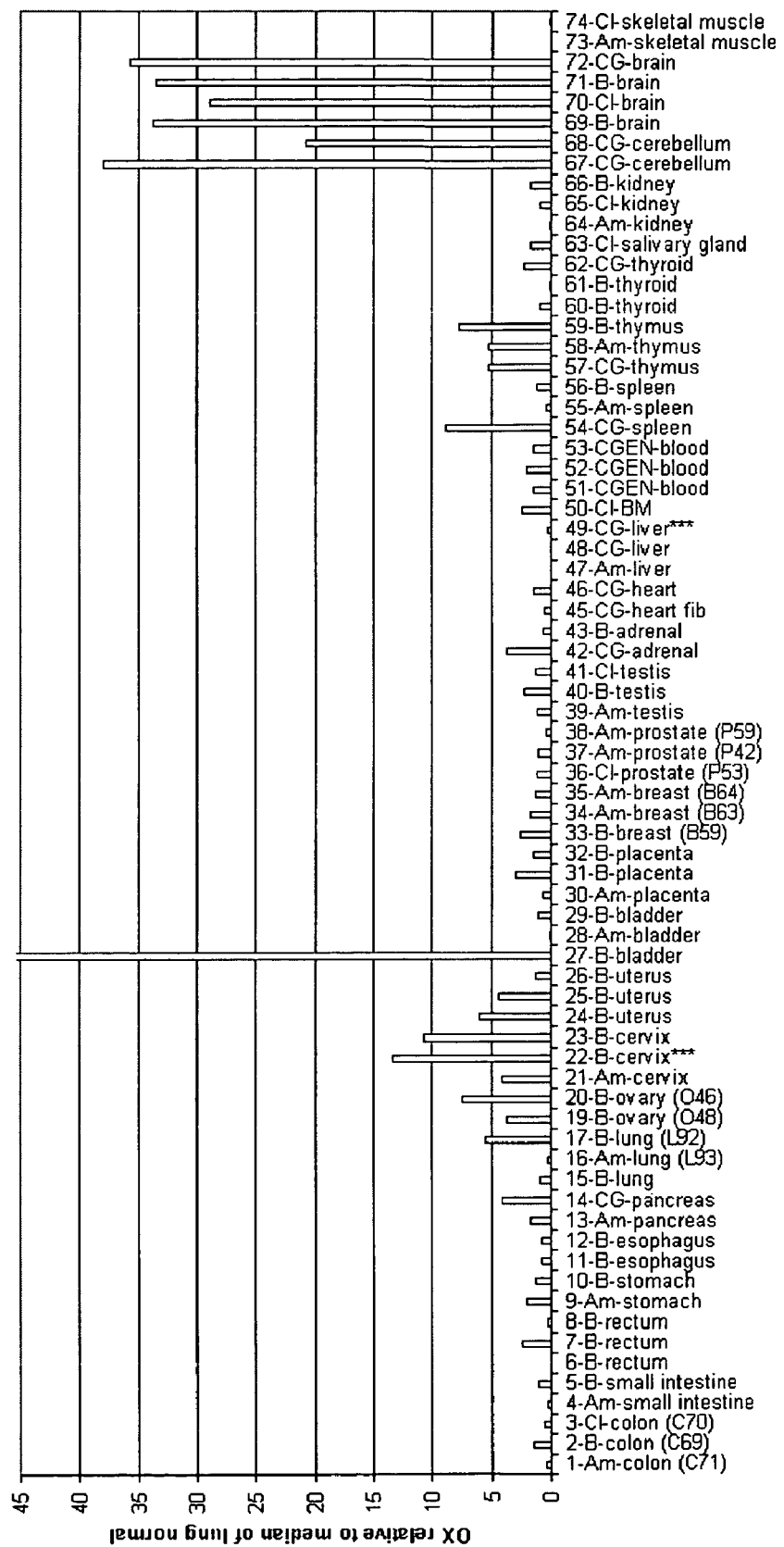
FIG. 16B is a histogram showing expression of *Homo sapiens* amyloid beta (A4) precursor-like protein 1 (APLP1) M78076 transcripts which are detectable by amplicon as depicted in sequence name M78076 seg46 in different normal tissues

FIG. 16B is a histogram showing expression of *Homo sapiens* amyloid beta (A4) precursor-like protein 1 (APLP1) M78076 transcripts which are detectable by amplicon as depicted in sequence name M78076 seg46 in different normal tissues.

Expression of Amyloid-like protein 1 M78076 transcripts which are detectable by amplicons as depicted in sequences names M78076seg46 (SEQ ID NO:481) and M78076seg32 (SEQ ID NO:478) in normal and cancerous breast tissues:

Expression of Amyloid-like protein 1 transcripts detectable by or according to seg46 and seg32, M78076seg46 (SEQ ID NO:481) and M78076seg32 (SEQ ID NO:478) amplicons and primers M78076seg46F (SEQ ID NO:479), M78076seg46R (SEQ ID NO:480), M78076seg32F2 (SEQ ID NO:476) and M78076seg32R2 (SEQ ID NO:477) was measured by real time PCR. In parallel the expression of four housekeeping genes—PBGD (GenBank Accession No. BC019323 (SEQ ID NO:430); amplicon -PBGD-amplicon (SEQ ID NO:433)), HPRT1 (GenBank Accession No. NM_000194 (SEQ ID NO:434); amplicon—HPRT1-amplicon (SEQ ID NO:437)), SDHA (GenBank Accession No. NM_004168 (SEQ ID NO:462); amplicon -SDHA-amplicon (SEQ ID NO:465)) and G6PD (GenBank Accession No. NM_000402 (SEQ ID NO:442); G6PD amplicon (SEQ ID NO:445)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-69, Table 2_5, above "Tissue samples in breast cancer testing panel"), to obtain a value of fold differential expression for each sample relative to median of the normal PM samples.

In one experiment that was carried out no differential expression in the cancerous samples relative to the normal PM samples was observed.

Primer pairs are also optionally and preferably encompassed within the present invention; for example, for the above experiment, the following primer pair was used as a non-limiting illustrative example only of a suitable primer pair: M78076seg46F (SEQ ID NO:479) and M78076seg32F2 (SEQ ID NO:476) forward primer; and M78076seg46R (SEQ ID NO:480) and M78076seg32R2 (SEQ ID NO:477) reverse primer.

The present invention also preferably encompasses any amplicon obtained through the use of any suitable primer pair; for example, for the above experiment, the following amplicon was obtained as a non-limiting illustrative example only of a suitable amplicon: M78076seg46 (SEQ ID NO:481) and M78076seg32 (SEQ ID NO:478).

```
Forward primer M78076seg46F (SEQ ID NO: 479):
GAACAGCCGGGTACCTAGGG

Reverse primer M78076seg46R (SEQ ID NO: 480):
GGCTTCTTTGAGGGTCCTGTG

Amplicon M78076seg46 (SEQ ID NO: 481):
GAACAGCCGGGTACCTAGGGGAAGAGACCAGAGGTCAGCGGCCAGGCTGTGATTCCC

AAAGCCACACAGGACCCTCAAAGAAGCC
```

The conversion of the M78076seg46 (SEQ ID NO:481) name to the currently available sequence version, as listed in Table 137, is as follows: M78076seg44.

```
Forward primer M78076seg32F2 (SEQ ID NO: 476):
ACCCTGGCTCCCATTACAGA

Reverse primer M78076seg32R2 (SEQ ID NO: 477):
GACCGGATGGCAGAATCATG

Amplicon M78076seg32 (SEQ ID NO: 478):
```

```
                        -continued
ACCCTGGCTCCCATTACAGATCTCTGAGGGCAGATCTTGACTCCTAAATGTTGGGCCC

CCCCAATTTCATTTATTCCTCTATAACAAACAGCCCAGACCTTAGCAGTGAAAATCAA

CAATGATTTTTCTTTGTTCATGATTCTGCCATCCGGTC
```

Description for Cluster Hsuparaa

Cluster HSUPARAA features 15 transcript(s) and 23 segment(s) of interest, the names for which are given in Tables 211 and 212, respectively, the sequences themselves are given at the end of the application. The selected protein variants are given in table 213.

TABLE 211

| Transcripts of interest Transcript Name |
| --- |
| HSUPARAA_T2 (SEQ ID NO: 178) |
| HSUPARAA_T3 (SEQ ID NO: 179) |
| HSUPARAA_T4 (SEQ ID NO: 180) |
| HSUPARAA_T10 (SEQ ID NO: 181) |
| HSUPARAA_T11 (SEQ ID NO: 182) |
| HSUPARAA_T14 (SEQ ID NO: 183) |
| HSUPARAA_T15 (SEQ ID NO: 184) |
| HSUPARAA_T16 (SEQ ID NO: 185) |
| HSUPARAA_T17 (SEQ ID NO: 186) |
| HSUPARAA_T19 (SEQ ID NO: 187) |
| HSUPARAA_T20 (SEQ ID NO: 188) |
| HSUPARAA_T21 (SEQ ID NO: 189) |
| HSUPARAA_T22 (SEQ ID NO: 190) |
| HSUPARAA_T24 (SEQ ID NO: 191) |
| HSUPARAA_T30 (SEQ ID NO: 192) |

TABLE 212

| Segments of interest Segment Name |
| --- |
| HSUPARAA_N0 (SEQ ID NO: 193) |
| HSUPARAA_N9 (SEQ ID NO: 194) |
| HSUPARAA_N13 (SEQ ID NO: 195) |
| HSUPARAA_N16 (SEQ ID NO: 196) |
| HSUPARAA_N22 (SEQ ID NO: 197) |
| HSUPARAA_N27 (SEQ ID NO: 198) |
| HSUPARAA_N35 (SEQ ID NO: 199) |
| HSUPARAA_N38 (SEQ ID NO: 200) |
| HSUPARAA_N40 (SEQ ID NO: 201) |
| HSUPARAA_N43 (SEQ ID NO: 202) |
| HSUPARAA_N44 (SEQ ID NO: 203) |
| HSUPARAA_N45 (SEQ ID NO: 204) |
| HSUPARAA_N7 (SEQ ID NO: 205) |
| HSUPARAA_N8 (SEQ ID NO: 206) |
| HSUPARAA_N11 (SEQ ID NO: 207) |
| HSUPARAA_N12 (SEQ ID NO: 208) |
| HSUPARAA_N19 (SEQ ID NO: 209) |
| HSUPARAA_N23 (SEQ ID NO: 210) |
| HSUPARAA_N28 (SEQ ID NO: 211) |
| HSUPARAA_N31 (SEQ ID NO: 212) |
| HSUPARAA_N32 (SEQ ID NO: 213) |
| HSUPARAA_N33 (SEQ ID NO: 214) |
| HSUPARAA_N39 (SEQ ID NO: 215) |

TABLE 213

| Proteins of interest | |
| --- | --- |
| Protein Name | Corresponding Transcript(s) |
| HSUPARAA_P1 (SEQ ID NO: 226) | HSUPARAA_T2 (SEQ ID NO: 178) |
| HSUPARAA_P2 (SEQ ID NO: 227) | HSUPARAA_T3 (SEQ ID NO: 179) |

TABLE 213-continued

| Proteins of interest | |
| --- | --- |
| Protein Name | Corresponding Transcript(s) |
| HSUPARAA_P7 (SEQ ID NO: 228) | HSUPARAA_T10 (SEQ ID NO: 181) |
| HSUPARAA_P8 (SEQ ID NO: 229) | HSUPARAA_T11 (SEQ ID NO: 182) |
| HSUPARAA_P11 (SEQ ID NO: 230) | HSUPARAA_T14 (SEQ ID NO: 183); HSUPARAA_T15 (SEQ ID NO: 184); HSUPARAA_T16 (SEQ ID NO: 185); HSUPARAA_T17 (SEQ ID NO: 186) |
| HSUPARAA_P13 (SEQ ID NO: 231) | HSUPARAA_T19 (SEQ ID NO: 187) |
| HSUPARAA_P14 (SEQ ID NO: 232) | HSUPARAA_T20 (SEQ ID NO: 188) |
| HSUPARAA_P15 (SEQ ID NO: 233) | HSUPARAA_T21 (SEQ ID NO: 189) |
| HSUPARAA_P16 (SEQ ID NO: 234) | HSUPARAA_T22 (SEQ ID NO: 190) |
| HSUPARAA_P20 (SEQ ID NO: 235) | HSUPARAA_T30 (SEQ ID NO: 192) |
| HSUPARAA_P26 (SEQ ID NO: 236) | HSUPARAA_T4 (SEQ ID NO: 180) |
| HSUPARAA_P27 (SEQ ID NO: 237) | HSUPARAA_T24 (SEQ ID NO: 191) |

These sequences are variants of the known protein Urokinase plasminogen activator surface receptor precursor (SEQ ID NO:216) (SwissProt accession identifier UPAR_H AN (SEQ ID NO:593); known also according to the synonyms UPAR; U-PAR; Monocyte activation antigen Mo3; CD87 antigen), referred to herein as the previously known protein.

Protein Urokinase plasminogen activator surface receptor precursor (SEQ ID NO:216) is known or believed to have the following function(s): Acts as a receptor for urokinase plasminogen activator. Plays a role in localizing and promoting plasmin formation. Mediates the proteolysis-independent signal transduction activation effects of U-PA. It is subject to negative-feedback regulation by U-PA which cleaves it into an inactive form. The sequence for protein Urokinase plasminogen activator surface receptor precursor (SEQ ID NO:216) is given at the end of the application, as "Urokinase plasminogen activator surface receptor precursor (SEQ ID NO:216) amino acid sequence". Known polymorphisms for this sequence are as shown in Table 214.

TABLE 214

| Amino acid mutations for Known Protein | |
| --- | --- |
| SNP position(s) on amino acid sequence | Comment |
| 55 | E -> G. /FTId = VAR_016322 |
| 86 | T -> A (in dbSNP: 399145). /FTId = VAR_016323 |
| 105 | R -> Q. /FTId = VAR_016324 |
| 220 | K -> R. /FTId = VAR_016325 |
| 281 | N -> K (in dbSNP: 4251921). /FTId = VAR_016326 |
| 317 | L -> P (in dbSNP: 4760). /FTId = VAR_014922 |
| 28 | C -> N |

TABLE 214-continued

Amino acid mutations for Known Protein

| SNP position(s) on amino acid sequence | Comment |
|---|---|
| 249 | G -> D |
| 252 | E -> G |

Protein Urokinase plasminogen activator surface receptor precursor (SEQ ID NO:216) localization is believed to be Attached to the membrane by a GPI-anchor (isoform 1) Secreted (isoform 2).

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Angiogenesis inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer, other; Ophthalmological.

The following GO Annotation(s) apply to the previously known protein. The following annotation(s) were found: blood coagulation; chemotaxis; signal transduction, which are annotation(s) related to Biological Process; protein binding; receptor activity, which are annotation(s) related to Molecular Function; and extrinsic to membrane; plasma membrane, which are annotation(s) related to Cellular Component.

The GO assignment relies on information from one or more of the SwissProt/TremB1 Protein knowledgebase, available from.ncbi.nlm.nih.gov/projects/Locuslink/>.

Urokinase plasminogen activator surface receptor precursor (SEQ ID NO:216) has the following SwissProt accession number: Q03405. This protein has a GPI anchored form and a soluble form which could be full or partly cleaved. The GPI anchored form is identified in SwissProt according to isoform identifier Q03405-1. The complete secreted form is identified in SwissProt according to isoform identifier Q03405-2 (SEQ ID NO:219). The partially cleaved form is identified in SwissProt according to isoform identifier Q03405-3 (SEQ ID NO:220).

uPAR is a heavily glycosylated glycosyl-phosphatidylinositol (GPI)-anchored cell-surface receptor, composed of 274 amino-acid residues, which binds uPA produced endogenously or released from surrounding cells, and focuses plasmin proteolytic activity on the relevant cell's surface. uPAR belongs to the Ly6/neurotoxin receptor family and consists of three internally disulfide-bonded domains (D1, D2 and D3). It is attached to the cell surface by a GPI anchor. The receptor has neither transmembrane nor cytoplasmic domains. The ligand-binding activity resides in the N-terminal domain, but all three domains are necessary to achieve a high-affinity binding of uPA. By binding to uPAR through its N-terminal domain, the catalytic C-terminal domain of (pro)-uPA is brought into physical proximity with membrane-bound plasminogen. This process results in the enzymatic activation of (pro)-uPA into uPA, which subsequently activates more plasminogen to generate additional plasmin in a mechanism that is referred to as 'reciprocal zymogen activation'.

A soluble uPAR (suPAR) has been characterized in the plasma of normal healthy subjects as well as in the plasma and body fluids of cancer patients. suPAR is released from the plasma membrane by cleavage of the GPI anchor. suPAR can be further cleaved in the region that links domain D1 to domain D2 to yield two fragments, respectively, composed of D1 and D2D3. The latter exhibits direct chemotactic activity. Soluble uPAR is also found in urine.

In terms of diagnostic activity, in cancer patients, peripheral blood levels of suPAR confer a poor prognosis, and could also serve as a surrogate marker for treatment response (Begum, F. D. et al. Anticancer Res 24, 1981-5 (2004); Ecke, T. H., et al., Anticancer Res 25, 635-41 (2005); Grebenchtchikov, N. et al. Oncol Rep 14, 235-9 (2005); Li, P. et al. J Pediatr Surg 39, 1512-9 (2004); Li, Y. J., et al., Ai Zheng 23, 704-6 (2004); Luther, T. et al. Thromb Haemost 89, 705-17 (2003); Memarzadeh, S. et al. Proc Natl Acad Sci U S A 99, 10647-52 (2002); Nijziel, M. R. et al. J Thromb Haemost 1, 982-6 (2003); Nishimura, K. et al. Int J Androl 26, 175-9 (2003); Ohba, K. et al. J Urol 174, 461-5 (2005); Qin, W., et al., Cancer J 9, 293-301 (2003); Shariat, S. F. et al. Urology 61, 1053-8 (2003); Sidenius, N. et al., Cancer Metastasis Rev 22, 205-22 (2003); Vivani, C. et al. Anal Quant Cytol Histol 26, 15-21 (2004); Werle, B. et al. Anticancer Res 24, 4147-61 (2004); Yue, S. Q., et al., World J Gastroenterol 10, 2750-2 (2004)). Non limiting examples of diagnostic uses of uPAR are listed in the table below.

| Diagnostic assay or use | Details | Reference |
|---|---|---|
| Diagnosis of Paroxysmal nocturnal hemoglobinuria (PNH) | The suPAR concentration of PNH plasma was 4.04 +/- 2.47 ng/mL, which was higher than that of the healthy individuals, 1.73 +/- 0.96 ng/mL (P < .01). | Gao W, et al., Int J Hematol. 2002 May; 75(4): 434-9. |
| Plasma soluble urokinase plasminogen activator receptor as a prognostic marker in rectal cancer patients. | suPAR concentration was significantly higher in Dukes' stage D patients than in Dukes' stage A-C patients (p < 0.0001). | Riisbro, R. et al. Int J Biol Markers. 2005 Apr-Jun; 20: 93-102.; Fernebro E, et al., Eur J Cancer. 2001 March; 37(4): 486-91.; Stephens RW et al., J Natl Cancer Inst. 1999 May 19; 91(10): 869-74. |

-continued

| Diagnostic assay or use | Details | Reference |
| --- | --- | --- |
| Diagnosis and staging of gynecological cancer, alone or in combination with FIGO and/or CA125. | No significant difference was found between plasma suPAR in the blood donors and the patients with benign diseases (P = 0.58). The groups of cancer patients had suPAR levels that were significantly higher than those found in the blood donors (P < 0.0001, P < 0.0001, and P = 0.001 for patients with ovarian, endometrial, and cervical cancer, respectively). In all groups of cancer patients a trend toward increasing suPAR levels with increasing FIGO stage was noted (P = 0.0003, P = 0.02, and P = 0.01 for patients with ovarian, endometrial, and cervical cancer, respectively). | Riisbro R, et al., Gynecol Oncol. 2001 September; 82(3): 523-31. Sier CF, et al., Cancer Res. 1998 May 1; 58(9): 1843-9. |
| Prognostic value of suPAR in primary breast cancer. | The mean c-suPAR level was 0.55 ng/mg protein (range, 0.07-2.83 ng/mg protein). The aa-s-suPAR levels were significantly increased in the patients as compared with the donors (P < 0.0001). During the follow-up period (5.9 years) 77 patients experienced a relapse and 69 died. aa-s-suPAR as a continuous variable was significantly associated with relapse-free survival [hazard ratio (HR), 1.4; 95% confidence interval (CI), 1.1-1.8; P = 0.003] and overall survival (HR, 1.6; 95% CI, 1.2-2.0; P < 0.0001). In multivariate Cox analysis including the classical prognostic parameters in breast cancer, continuous aa-s-suPAR was significantly associated with both relapse-free survival (HR, 1.4; 95% CI, 1.1-1.7; P = 0.001) and overall survival (HR, 1.4; 95% CI, 1.1-1.8; P = 0.002). | Riisbro R, et al, Clin Cancer Res. 2002 May; 8(5): 1132-41. Grondahl-Hansen J, et al., Clin Cancer Res. 1997 February; 3(2): 233-9. Foekens JA et al., J Clin Oncol. 1994 August; 12(8): 1648-58. |
| suPAR may serve for the detection of prostate cancer and for the prediction of patient prognosis, alone or in combination with PSA. | Serum levels of suPAR were high in cancer patients as well as, although to a lesser degree, in patients with BPH. Cancer patients who died during the follow-up period were found to have consistently higher serum suPAR levels than correlating serum PSA levels. | McCabe NP., et al., Oncol Rep. 2000 July-August; 7(4): 879-82. |
| suPAR may serve as a predictor of survival in human immunodeficiency virus infection. | By Kaplan-Meier and Cox regression analyses, the serum suPAR levels were correlated to survival with AIDS-related death as the end point. High levels of serum suPAR (greater than median) were associated with poor overall survival, | Sidenius N, et al., Blood. 2000 Dec. 15; 96(13): 4091-5. Ostrowski SR et al., J Acquir Immune Defic Syndr. 2005 May 1; 39(1): 23-31. Ostrowski SR, et al., J Acquir Immune Defic Syndr. 2004 Apr. |

-continued

| Diagnostic assay or use | Details | Reference |
|---|---|---|
| | and Kaplan-Meier analysis on patients stratified by suPAR level demonstrated a continuous increase in mortality rates with higher suPAR levels. | 1; 35(4): 337-42. |
| Prognostic impact of liberated domain I of the urokinase plasminogen activator receptor in squamous cell lung cancer tissue | Univariate analysis using log transformed uPAR(I) concentrations showed that there was an increasing risk of mortality with increasing uPAR(I) levels in SCC tumour extracts, the hazard ratio (HR) being 2.9 with a P-value of 0.003. In a multivariate analysis, including uPAR(I), gender, age, nodal status, tumour size and levels of uPAR immunoreactivity measured by ELISA, statistically significant prognostic impact was found only for levels of uPAR(I) (HR 3.7, P = 0.002) and tumour size (HR 2.4, P = 0.02). | Almasi, C. E., et al., Lung Cancer. 2005 June; 48(3): 349-55. |
| High expression of urokinase plasminogen activator receptor (UPA-R) in acute myeloid leukemia (AML) is associated with worse prognosis. | In the group of patients who did not respond to AML-CG therapy, significantly higher proportions of UPA-R+ cells (31% vs. 14%, P = 0.0015, t-test) were found. | Graf, M. et al. Am J Hematol. 2005 May; 79: 26-35. |
| Prognostic role of UPAR in metastasis and invasion of neuroblastoma. | The positive rate of uPAR in the high-risk group (22 of 25, 88.0%) was substantially higher compared with that in intermediate-risk group (6 of 17, 35.3%) and low-risk group (2 of 10, 20.0%; P < .01). The positive rate of uPAR in UH (24 of 29, 82.8%) was higher compared with that in FH (6 of 23, 26.1%), and J Pediatr Surg. 2004 Oct; 39(10): 1512-9. statistical significance was remarkable (P < .01). | |
| The plasma level of soluble urokinase receptor is elevated in patients with Streptococcus pneumoniae bacteraemia and predicts mortality. | In multivariate analysis, only suPAR remained a significant predictor of death (mortality rate of 13 for suPAR levels of >10 ng/mL; 95% CI: 1.1-158). | Wittenhagen P., et al., Clin Microbiol Infect. 2004 May; 10(5): 409-15. |

As noted above, cluster HSUPARAA features 15 transcript(s), which were listed in Table 211 above. These transcript(s) encode for protein(s) which are variant(s) of protein Urokinase plasminogen activator surface receptor precursor (SEQ ID NO:216). A description of each variant protein according to the present invention is now provided.

Variant protein HSUPARAA-PI (SEQ ID NO:226) according to the present invention has an amino acid sequence as given at the end of the application; it is encoded by transcript(s) HSUPARAA_T2 (SEQ ID NO:178). An alignment is given to the known protein (Urokinase plasminogen activator surface receptor precursor (SEQ ID NO:216)) at the end of the application. One or more alignments to one or more previously published protein sequences are given at the end of the application. A brief description of the relationship of the variant protein according to the present invention to each such aligned protein is as follows:

1. Comparison Report Between HSUPARAA_P1 (SEQ ID NO:226) and UPAR_HUMAN (SEQ ID NO:593):

A. An isolated chimeric polypeptide encoding for HSUPARAA_P1 (SEQ ID NO:226), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE- EQCLDVVTHWIQEGEEGRPKDDRHL-
RGCGYLPGCPGSN GFHNNDTFHFLKCCNTTKCNEGP corresponding to amino acids 1-202 of UPAR_HUMAN (SEQ ID NO:593), which also corresponds to amino acids 1-202 of HSUPARAA_P1 (SEQ ID NO:226), and a second amino acid sequence being at least 70%, optionally at least 80%, preferably at least 85%, more preferably at least 90% and most preferably at least 95% homologous to a polypeptide having the sequence SKERETQSWSLKICRRMAAS-VTAARGTAPMDAPLKRLSSLTAEAP (SEQ ID NO:558) corresponding to amino acids 203-247 of HSUPARAA_P1 (SEQ ID NO:226), wherein said first amino acid sequence and second amino acid sequence are contiguous and in a sequential order.

B. An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence SKERETQSWSLKICRRMAAS-VTAARGTAPMDAPLKRLSSLTAEAP (SEQ ID NO:558) of HSUPARAA_P1 (SEQ ID NO:226).

2. Comparison Report Between HSUPARAA_P1 (SEQ ID NO:226) and Q9UPI5_HUMAN (SEQ ID NO:218):

A. An isolated chimeric polypeptide encoding for HSU-PARAA_P1 (SEQ ID NO:226), comprising a first amino acid sequence being at least 90% homologous to 30 MGHPPLL-PLLLLLHTCVPASWGLRCMQCKTNGD-
CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-
RGCGYLPGCPGSN GFHNNDTFHFLKCCNTTKCNEGP corresponding to amino acids 1-202 of Q9UPI5_HUMAN (SEQ ID NO:218), which also corresponds to amino acids 1-202 of HSUPARAA_P1 (SEQ ID NO:226), and a second amino acid sequence being at least 70%, optionally at least 80%, preferably at least 85%, more preferably at least 90% and most preferably at least 95% homologous to a polypeptide having the sequence SKERETQSWSLKICRRMAAS-VTAARGTAPMDAPLKRLSSLTAEAP (SEQ ID NO:558) corresponding to amino acids 203-247 of HSUPARAA_P1 (SEQ ID NO:226), wherein said first amino acid sequence and second amino acid sequence are contiguous and in a sequential order.

B. An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence SKERETQSWSLKICRRMAAS-VTAARGTAPMDAPLKRLSSLTAEAP (SEQ ID NO:558) of HSUPARAA_P1 (SEQ ID NO:226).

3. Comparison Report Between HSUPARAA_P1 (SEQ ID NO:226) and Q03405-2 (SEQ ID NO:219):

A. An isolated chimeric polypeptide encoding for HSU-PARAA_P1 (SEQ ID NO:226), comprising a first amino acid sequence being at least 90% homologous to MGHPPLL-PLLLLLHTCVPASWGLRCMQCKTNGD-
CRVEECALGQDLCRTTWRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-
RGCGYLPGCPGSN GFHNNDTFHFLKCCNTTKCNEGP corresponding to amino acids 1-202 of Q03405-2 (SEQ ID NO:219), which also corresponds to amino acids 1-202 of HSUPARAA_P1 (SEQ-ID NO:226), and a second amino acid sequence being at least 70%, optionally at least 80%, preferably at least 85%, more preferably at least 90% and most preferably at least 95% homologous to a polypeptide having the sequence SKERETQSWSLKICRRMAAS-VTAARGTAPMDAPLKRLSSLTAEAP (SEQ ID NO:558) corresponding to amino acids 203-247 of HSUPARAA_P1 (SEQ ID NO:226), wherein said first amino acid sequence and second amino acid sequence are contiguous and in a sequential order.

B. An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence SKERETQSWSLKICRRMAAS-VTAARGTAPMDAPLKRLSSLTAEAP (SEQ ID NO:558) of HSUPARAA_P1 (SEQ ID NO:226).

4. Comparison Report Between HSUPARAA-PI (SEQ ID NO:226) and NP_001005376 (SEQ ID NO:222):

A. An isolated chimeric polypeptide encoding for HSU-PARAA_P1 (SEQ ID NO:226), comprising a first amino acid sequence being at least 90% homologous to MGHPPLL-PLLLLLHTCVPASWGLRCMQCKTNGD-
CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-
RGCGYLPGCPGSN GFHNNDTFHFLKCCNTTKCNEGP corresponding to amino acids 1-202 of NP_001005376 (SEQ ID NO:222), which also corresponds to amino acids 1-202 of HSUPARAA_P1 (SEQ ID NO:226), and a second amino acid sequence being at least 70%, optionally at least 80%, preferably at least 85%, more preferably at least 90% and most preferably at least 95% homologous to a polypeptide having the sequence SKERETQSWSLKICRRMAAS-VTAARGTAPMDAPLKRLSSLTAEAP (SEQ ID NO:558) corresponding to amino acids 203-247 of HSUPARAA_P1 (SEQ ID NO:226), wherein said first amino acid sequence and second amino acid sequence are contiguous and in a sequential order.

B. An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence SKERETQSWSLKICRRMAAS-VTAARGTAPMDAPLKRLSSLTAEAP (SEQ ID NO:558) of HSUPARAA_P1 (SEQ ID NO:226).

5. Comparison Report Between HSUPARAA_P1 (SEQ ID NO:226) and Q9BWT0_HUMAN (SEQ ID NO:223):

A. An isolated chimeric polypeptide encoding for HSU-PARAA P1 (SEQ ID NO:226), comprising a first amino acid sequence being at least 90% homologous to MGHPPLL-PLLLLLHTCVPASWGLRCMQCKTNGD-
CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDR corresponding to amino acids 1-164 of Q9BWT0_HUMAN (SEQ ID NO:223), which also corresponds to amino acids 1-164 of HSUPARAA_P1 (SEQ ID NO:226), a bridging amino acid H corresponding to amino acid 165 of HSUPARAA_P1 (SEQ ID NO:226), a second amino acid sequence being at least 90% homologous to LRGCGYLPGCPGSNGFHNNDTFH-FLKCCNTTKCNEGP corresponding to amino acids 166-

202 of Q9BWT0_HUMAN (SEQ ID NO:223), which also corresponds to amino acids 166-202 of HSUPARAA_P1 (SEQ ID NO:226), and a third amino acid sequence being at least 70%, optionally at least 80%, preferably at least 85%, more preferably at least 90% and most preferably at least 95% homologous to a polypeptide having the sequence SKERETQSWSLKICRRMAASVTAARG-TAPMDAPLKRLSSLTAEAP (SEQ ID NO:558) corresponding to amino acids 203-247 of HSUPARAA_P1 (SEQ ID NO:226), wherein said first amino acid sequence, bridging amino acid, second amino acid sequence and third amino acid sequence are contiguous and in a sequential order.

B. An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least lo about 95% homologous to the sequence SKERETQSWSLKICRRMAASVTAARGTAPMDAPLKRLSSLTAEAP (SEQ ID NO:558) of HSUPARAA_P1 (SEQ ID NO:226).

6. Comparison Report Between HSUPARAA_P1 (SEQ ID NO:226) and NP_002650 (SEQ ID NO:217):

A. An isolated chimeric polypeptide encoding for HSUPARAA_P1 (SEQ ID NO:226), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEGP corresponding to amino acids 1-202 of NP_002650 (SEQ ID NO:217), which also corresponds to amino acids 1-202 of HSUPARAA_P1 (SEQ ID NO:226), and a second amino acid sequence being at least 70%, optionally at least 80%, preferably at least 85%, more preferably at least 90% and most preferably at least 95% homologous to a polypeptide having the sequence SKERETQSWSLKICRRMAASVTAARG-TAPMDAPLKRLSSLTAEAP (SEQ ID NO:558) corresponding to amino acids 203-247 of HSUPARAA-PI (SEQ ID NO:226), wherein said first amino acid sequence and second amino acid sequence are contiguous and in a sequential order.

B. An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence SKERETQSWSLKICRRMAASVTAARGTAPMDAPLKRLSSLTAEAP (SEQ ID NO:558) of HSUPARAA_P1 (SEQ ID NO:226).

7. Comparison Report Between HSUPARAA_P1 (SEQ ID NO:226) and NP_001005377 (SEQ ID NO:221):

A. An isolated chimeric polypeptide encoding for HSUPARAA_P1 (SEQ ID NO:226), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEE corresponding to amino acids 1-157 of NP_001005377 (SEQ ID NO:221), which also corresponds to amino acids 1-157 of HSUPARAA_P1 (SEQ ID NO:226), and a second amino acid sequence being at least 70%, optionally at least 80%, preferably at least 85%, more preferably at least 90% and most preferably at least 95% homologous to a pol),peptide having the sequence GRPKD-DRHLRGCGYLPGCPGSNGFHNNDTFH-FLKCCNTTKCNEGPSKERETQSWSLKICR RMAAS-VTAARGTAPMDAPLKRLSSLTAEAP (SEQ ID NO:559) corresponding to amino acids 158-247 of HSUPARAA_P1 (SEQ ID NO:226), wherein said first amino acid sequence and second amino acid sequence are contiguous and in a sequential order.

B. An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKC-NEGPSKERETQSWSLKICR RMAASVTAARGTAPMDAPLKRLSSLTAEAP (SEQ ID NO:559) of HSUPARAAyP1 (SEQ ID NO:226).

8. Comparison Report Between HSUPARAA_P1 (SEQ ID NO:226) and Q03405-3 (SEQ ID NO:220):

A. An isolated chimeric polypeptide encoding for HSUPARAA_P1 (SEQ ID NO:226), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEE corresponding to amino acids 1-157 of Q03405-3 (SEQ ID NO:220), which also corresponds to amino acids 1-157 of HSUPARAA_P1 (SEQ ID NO:226), and a second amino acid sequence being at least 70%, optionally at least 80%, preferably at least 85%, more preferably at least 90% and most preferably at least 95% homologous to a polypeptide having the sequence GRPKD-DRHLRGCGYLPGCPGSNGFHNNDTFH-FLKCCNTTKCNEGPSKERETQSWSLKICR RMAAS-VTAARGTAPMDAPLKRLSSLTAEAP (SEQ ID NO:559) corresponding to amino acids 158-247 of HSUPARAA_P1 (SEQ ID NO:226), wherein said first amino acid sequence and second amino acid sequence are contiguous and in a sequential order.

B. An isolated polypeptide encoding for an edge portion of HSUPARAA_P1 (SEQ ID NO:226), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKC-NEGPSKERETQSWSLKICR RMAASVTAARGTAPMDAPLKRLSSLTAEAP (SEQ ID NO:559) of HSUPARAAyP1 (SEQ ID NO:226).

The localization of the variant protein was determined according to results from a number of different software programs and analyses, including analyses from SignalP and other specialized programs. The variant protein is believed to be located as follows with regard to the cell: secreted.

Variant protein HSUPARAA_P1 (SEQ ID NO:226) also has the following non-silent SNPs (Single Nucleotide Polymorphisms) as listed in Table 215, (given according to their position(s) on the amino acid sequence, with the alternative amino acid(s) listed; the last column indicates whether the SNP is known or not; the presence of known SNPs in variant protein HSUPARAA_P1 (SEQ ID NO:226) sequence provides support for the deduced sequence of this variant protein according to the present invention).

TABLE 215

Amino acid mutations

| SNP position(s) on amino acid sequence | Alternative amino acid(s) | Previously known SNP? |
|---|---|---|
| 17 | V -> | No |
| 55 | E -> G | Yes |
| 78 | S -> N | No |
| 86 | T -> A | Yes |
| 100 | Q -> | No |
| 105 | R -> Q | Yes |
| 171 | Y -> * | No |
| 171 | Y -> | No |
| 184 | N -> D | No |
| 193 | C -> R | No |
| 195 | T -> S | No |
| 219 | M -> V | No |
| 227 | R -> G | Yes |

The glycosylation sites of variant protein HSUPARAA_P1 (SEQ ID NO:226), as compared to the known protein Urokinase plasminogen activator surface receptor precursor (SEQ ID NO:216), are described in Table 216 (given according to their position(s) on the amino acid sequence in the first column; the second column indicates whether the glycosylation site is present in the variant protein; and the last column indicates whether the position is different on the variant protein).

TABLE 216

Glycosylation site(s)

| Position(s) on known amino acid sequence | Present in variant protein? | Position(s) on variant protein |
|---|---|---|
| 74 | Yes | 74 |
| 184 | Yes | 184 |
| 194 | Yes | 194 |
| 222 | No | |
| 255 | No | |

The variant protein has the following domains, as determined by using InterPro. The domains are described in Table 217:

TABLE 217

InterPro domain(s)

| Domain description | Analysis type | Position(s) on protein |
|---|---|---|
| Urokinase plasminogen activator surface receptor | BlastProDom | 14-108 |
| CD59 antigen | HMMPfam | 23-100 |
| CD59 antigen | HMMSmart | 23-110, 115-210 |
| CD59 antigen | ScanRegExp | 24-67, 116-169 |

Variant protein HSUPARAA_P1 (SEQ ID NO:226) is encoded by the following transcript(s): HSUPARAA_T2 (SEQ ID NO:178), for which the sequence(s) is/are given at the end of the application. The coding portion of transcript HSUPARAA_T2 (SEQ ID NO:178) is shown in bold; this coding portion starts at position 428 and ends at position 1168. The transcript also has the following SNPs as listed in Table 218 (given according to their position on the nucleotide sequence, with the alternative nucleic acid listed; the last column indicates whether the SNP is known or not; the presence of known SNPs in variant protein HSUPARAA_P1 (SEQ ID NO:226) sequence provides support for the deduced sequence of this variant protein according to the present invention).

TABLE 218

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 649 | C -> T | Yes |
| 660 | G -> A | No |
| 683 | A -> G | Yes |
| 727 | G -> | No |
| 741 | G -> A | Yes |
| 901 | G -> A | No |
| 940 | C -> A | No |
| 940 | C -> | No |
| 977 | A -> G | No |
| 1004 | T -> C | No |
| 1011 | C -> G | No |
| 1082 | A -> G | No |
| 1106 | A -> G | Yes |
| 1106 | -> G | No |
| 1172 | A -> G | No |
| 1180 | C -> T | No |
| 1191 | C -> T | Yes |
| 1200 | C -> T | Yes |
| 1207 | A -> T | No |
| 1242 | C -> T | Yes |
| 1290 | C -> A | Yes |
| 1337 | A -> C | Yes |
| 1363 | G -> | No |
| 1363 | G -> T | No |
| 1380 | C -> G | No |
| 1397 | T -> C | Yes |
| 1406 | C -> T | No |
| 1443 | C -> A | Yes |
| 1450 | A -> T | No |
| 1494 | G -> A | Yes |
| 1496 | C -> A | No |
| 1496 | C -> | No |
| 1513 | C -> T | Yes |
| 1561 | G -> A | Yes |
| 1568 | C -> T | No |
| 1617 | G -> C | Yes |
| 1646 | G -> | No |

Variant protein HSUPARAA_P2 (SEQ ID NO:227) according to the present invention has an amino acid sequence as given at the end of the application; it is encoded by transcript(s) HSUPARAA_T3 (SEQ ID NO:179). An alignment is given to the known protein (Urokinase plasminogen activator surface receptor precursor (SEQ ID NO:216)) at the end of the application. One or more alignments to one or more previously published protein sequences are given at the end of the application. A brief description of the relationship of the variant protein according to the present invention to each such aligned protein is as follows:

1. Comparison Report Between HSUPARAA_P2 (SEQ ID NO:227) and UPAR_HUMAN (SEQ ID NO:593):

A. An isolated chimeric polypeptide encoding for HSUPARAA_P2 (SEQ ID NO:227), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH- SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEGP corresponding to amino acids 1-202 of UPAR_HUMAN (SEQ ID NO:593), which also corresponds to amino acids 1-202 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence SLLLSPGA (SEQ ID NO:560) corresponding to amino acids 203-210 of HSUPARAA_P2 (SEQ ID NO:227), wherein said first amino acid sequence and second amino acid sequence are contiguous and in a sequential order.

B. An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence SLLLSPGA (SEQ ID NO:560) of HSUPARAA_P2 (SEQ ID NO:227).

2. Comparison Report Between HSUPARAA_P2 (SEQ ID NO:227) and Q9UPI5_HUMAN (SEQ ID NO:218):

A. An isolated chimeric polypeptide encoding for HSUPARAA_P2 (SEQ ID NO:227), comprising a first amino acid sequence being at least 90% homologous to MGHPPLL-PLLLLLHTCVPASWGLRCMQCKTNGD-CRVEECALGQDLCRTTFVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEGP corresponding to amino acids 1-202 of Q9UPI5_HUMAN (SEQ ID NO:218), which also corresponds to amino acids 1-202 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence SLLLSPGA (SEQ ID NO:560) corresponding to amino acids 203-210 of HSUPARAA_P2 (SEQ ID NO:227), wherein said first amino acid sequence and second amino acid sequence are contiguous and in a sequential order.

B. An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence SLLLSPGA (SEQ ID NO:560) of HSUPARAA_P2 (SEQ ID NO:227).

3. Comparison Report Between HSUPARAA_P2 (SEQ ID NO:227) and Q03405-2 (SEQ ID NO:219):

A. An isolated chimeric polypeptide encoding for HSUPARAA_P2 (SEQ ID NO:227), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEGP corresponding to amino acids 1-202 of Q03405-2 (SEQ ID NO:219), which also corresponds to amino acids 1-202 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence SLLLSPGA (SEQ ID NO:560) corresponding to amino acids 203-210 of HSUPARAA_P2 (SEQ ID NO:227), wherein said first amino acid sequence and second amino acid sequence are contiguous and in a sequential order.

B. An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence SLLLSPGA (SEQ ID NO:560) of HSUPARAA_P2 (SEQ ID NO:227).

4. Comparison Report Between HSUPARAA_P2 (SEQ ID NO:227) and NP_001005376 (SEQ ID NO:222):

A. An isolated chimeric polypeptide encoding for HSUPARAA_P2 (SEQ ID NO:227), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEGP corresponding to amino acids 1-202 of NP_001005376 (SEQ ID NO:222), which also corresponds to amino acids 1-202 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence SLLLSPGA (SEQ ID NO:560) corresponding amino acids 203-210 of HSUPARAA_P2 (SEQ ID NO:227), wherein said first amino acid sequence and second amino acid sequence are contiguous and in a sequential order.

B. An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence SLLLSPGA (SEQ ID NO:560) of HSUPARAA_P2 (SEQ ID NO:227).

5. Comparison Report Between HSUPARAA_P2 (SEQ ID NO:227) and Q9BWT0_HUMAN (SEQ ID NO:223):

A. An isolated chimeric polypeptide encoding for HSUPARAA_P2 (SEQ ID NO:227), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDR corresponding to amino acids 1-164 of Q9BWT0_HUMAN (SEQ ID NO:223), which also corresponds to amino acids 1-164 of HSUPARAA_P2 (SEQ ID NO:227), a bridging amino acid H corresponding to amino acid 165 of HSUPARAA_P2 (SEQ ID NO:227), a second amino acid sequence being at least 90% homologous to LRGCGYLPGCPGSNGFHNNDTFH-FLKCCNTTKCNEGP corresponding to amino acids 166-202 of Q9BWT0_HUMAN (SEQ ID NO:223), which also corresponds to amino acids 166-202 of HSUPARAA_P2 (SEQ ID NO:227), and a third amino acid sequence being at least 70%, optionally at least 80%, preferably at least 85%, more preferably at least 90% and most preferably at least 95% homologous to a polypeptide having the sequence SLLL-SPGA (SEQ ID NO:560) corresponding to amino acids 203-

210 of HSUPARAA_P2 (SEQ ID NO:227), wherein said first amino acid sequence, bridging amino acid, second amino acid sequence and third amino acid sequence are contiguous and in a sequential order.

B. An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence SLLLSPGA (SEQ ID NO:560) of HSUPARAA_P2 (SEQ ID NO:227).

6. Comparison Report Between HSUPARAA_P2 (SEQ ID NO:227) and NP_002650 (SEQ ID NO:217):

A. An isolated chimeric polypeptide encoding for HSUPARAA_P2 (SEQ ID NO:227), comprising a first amino acid sequence being at least 90% homologous to MGHPPLLPLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEGP corresponding to amino acids 1-202 of NP_002650 (SEQ ID NO:217), which also corresponds to amino acids 1-202 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence SLLLSPGA (SEQ ID NO:560) corresponding to amino acids 203-210 of HSUPARAA_P2 (SEQ ID NO:227), wherein said first amino acid sequence and second amino acid sequence are contiguous and in a sequential order.

B. An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence SLLLSPGA (SEQ ID NO:560) of HSUPARAA_P2 (SEQ ID NO:227).

7. Comparison Report Between HSUPARAA_P2 (SEQ ID NO:227) and NP_001005377 (SEQ ID NO:221):

A. An isolated chimeric polypeptide encoding for HSUPARAA_P2 (SEQ ID NO:227), comprising a first amino acid sequence being at least 90% homologous to MGHPPLLPLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEE corresponding to amino acids 1-157 of NP_001005377 (SEQ ID NO:221), which also corresponds to amino acids 1-157 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence GRPKDDRHLRGCGYLPGCPGSNGFHNNDTFH-FLKCCNTTKCNEGPSLLLSPGA (SEQ ID NO:561) corresponding to amino acids 158-210 of HSUPARAA_P2 (SEQ ID NO:227), wherein said first amino acid sequence and second amino acid sequence are contiguous and in a sequential order.

B. An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGPSLLLSPGA (SEQ ID NO:561) of HSUPARAA_P2 (SEQ ID NO:227).

8. Comparison Report Between HSUPARAA_P2 (SEQ ID NO:227) and Q03405-3 (SEQ ID NO:220):

A. An isolated chimeric polypeptide encoding for HSUPARAA_P2 (SEQ ID NO:227), comprising a first amino acid sequence being at least 90% homologous to MGHPPLLPLLLLLHTCVPASWGLRCMQCKTNGD-CRVEECALGQDLCRTTIRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEE corresponding to amino acids 1-157 of Q03405-3 (SEQ ID NO:220), which also corresponds to amino acids 1-157 of HSUPARAA_P2 (SEQ ID NO:227), and a second amino acid sequence being at least 70%, optionally at least 80%, preferably at least 85%, more preferably at least 90% and most preferably at least 95% homologous to a polypeptide having the sequence GRPKDDRHLRGCGYLPGCPGSNGFHNNDTFH-FLKCCNTTKCNEGPSLLLSPGA (SEQ ID NO:561) corresponding to amino acids 158-210 of HSUPARAA_P2 (SEQ ID NO:227), wherein said first amino acid sequence and second amino acid sequence are contiguous and in a sequential order.

B. An isolated polypeptide encoding for an edge portion of HSUPARAA_P2 (SEQ ID NO:227), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGPSLLLSPGA (SEQ ID NO:561) of HSUPARAA_P2 (SEQ ID NO:227).

The localization of the variant protein was determined according to results from a number of different software programs and analyses, including analyses from SignalP and other specialized programs. The variant protein is believed to be located as follows with regard to the cell: secreted.

Variant protein HSUPARAA_P2 (SEQ ID NO:227) also has the following non-silent SNPs (Single Nucleotide Polymorphisms) as listed in Table 219, (given according to their position(s) on the amino acid sequence, with the alternative amino acid(s) listed; the last column indicates whether the SNP is known or not; the presence of known SNPs in variant protein HSUPARAA_P2 (SEQ ID NO:227) sequence provides support for the deduced sequence of this variant protein according to the present invention).

TABLE 219

Amino acid mutations

| SNP position(s) on amino acid sequence | Alternative amino acid(s) | Previously known SNP? |
|---|---|---|
| 17 | V -> | No |
| 55 | E -> G | Yes |
| 78 | S -> N | No |
| 86 | T -> A | Yes |
| 100 | Q -> | No |
| 105 | R -> Q | Yes |
| 171 | Y -> * | No |
| 171 | Y -> | No |
| 184 | N -> D | No |
| 193 | C -> R | No |
| 195 | T -> S | No |

The glycosylation sites of variant protein HSUPARAA_P2 (SEQ ID NO:227), as compared to the known protein Urokinase plasminogen activator surface receptor precursor (SEQ ID NO:216), are described in Table 220 (given according to their position(s) on the amino acid sequence in the first column; the second column indicates whether the glycosylation site is present in the variant protein; and the last column indicates whether the position is different on the variant protein).

TABLE 220

Glycosylation site(s)

| Position(s) on known amino acid sequence | Present in variant protein? | Position(s) on variant protein |
|---|---|---|
| 74 | Yes | 74 |
| 184 | Yes | 184 |
| 194 | Yes | 194 |
| 222 | No | |
| 255 | No | |

The variant protein has the following domains, as determined by using InterPro. The domains are described in Table 221:

TABLE 221

InterPro domain(s)

| Domain description | Analysis type | Position(s) on protein |
|---|---|---|
| Urokinase plasminogen activator surface receptor | BlastProDom | 14-108 |
| CD59 antigen | HMMPfam | 23-100 |
| CD59 antigen | HMMSmart | 23-110, 115-207 |
| CD59 antigen | ScanRegExp | 24-67, 116-169 |

Variant protein HSUPARAA_P2 (SEQ ID NO:227) is encoded by the following transcript(s): HSUPARAA_T3 (SEQ ID NO:179), for which the sequence(s) is/are given at the end of the application. The coding portion of transcript HSUPARAA_T3 (SEQ ID NO:179) is shown in bold; this coding portion starts at position 428 and ends at position 1057. The transcript also has the following SNPs as listed in Table 222 (given according to their position on the nucleotide sequence, with the alternative nucleic acid listed; the last column indicates whether the SNP is known or not; the presence of known SNPs in variant protein HSUPARAA_P2 (SEQ ID NO:227) sequence provides support for the deduced sequence of this variant protein according to the present invention).

TABLE 222

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 649 | C -> T | Yes |
| 660 | G -> A | No |
| 683 | A -> G | Yes |
| 727 | G -> | No |
| 741 | G -> A | Yes |

TABLE 222-continued

Nucleic acid SNPs

| SNP position(s) on nucleotide sequence | Alternative nucleic acid(s) | Previously known SNP? |
|---|---|---|
| 901 | G -> A | No |
| 940 | C -> A | No |
| 940 | C -> | No |
| 977 | A -> G | No |
| 1004 | T -> C | No |
| 1011 | C -> G | No |
| 1075 | A -> G | No |
| 1099 | A -> G | Yes |
| 1099 | -> G | No |
| 1165 | A -> G | No |
| 1173 | C -> T | No |
| 1184 | C -> T | Yes |
| 1193 | C -> T | Yes |
| 1200 | A -> T | No |
| 1235 | C -> T | Yes |
| 1283 | C -> A | Yes |
| 1330 | A -> C | Yes |
| 1356 | G -> | No |
| 1356 | G -> T | No |
| 1373 | C -> G | No |
| 1390 | T -> C | Yes |
| 1399 | C -> T | No |
| 1436 | C -> A | Yes |
| 1443 | A -> T | No |
| 1487 | G -> A | Yes |
| 1489 | C -> A | No |
| 1489 | C -> | No |
| 1506 | C -> T | Yes |
| 1554 | G -> A | Yes |
| 1561 | C -> T | No |
| 1610 | G -> C | Yes |
| 1639 | G -> | No |

Variant protein HSUPARAA_P7 (SEQ ID NO:228) according to the present invention has an amino acid sequence as given at the end of the application; it is encoded by transcript(s) HSUPARAA_T10 (SEQ ID NO:181). An alignment is given to the known protein (Urokinase plasminogen activator surface receptor precursor (SEQ ID NO:216)) at the end of the application. One or more alignments to one or more previously published protein sequences are given at the end of the application. A brief description of the relationship of the variant protein according to the present invention to each such aligned protein is as follows:

1. Comparison Report Between HSUPARAA_P7 (SEQ ID NO:228) and UPAR_HUMAN (SEQ ID NO: 593):

A. An isolated chimeric polypeptide encoding for HSUPARAA_P7 (SEQ ID NO:228), comprising a first amino acid sequence being at least 90% homologous to MGHPPLLPLLLLLHTCVPASWGLRCMQCKTNGDCRVEECALGQDLCRTTIVRLWE corresponding to amino acids 1-55 of UPAR_HUMAN (SEQ ID NO:593), which also corresponds to amino acids 1-55 of HSUPARAA_P7 (SEQ ID) NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), and a third amino acid sequence being at least 90% homologous to EGEELELVEKSCTHSEKTNRTLSYRTGLKITSLTEVVCGLDLCNQGNSGRAVTYSRSRYLE CISCGSSDMSCERGRHQSLQCRSPEEQCLDVVTHWIQEGEEGRPK DDRHLRGCGYLPGCP GSNGFHNNDTFHFLKCCNTTKCNEGPILELENLPQNGRQCYSCKGNSTHGCSSEETFLIDC RGPMNQCLVATGTHEPKNQSYMVRG-
CATASMCQHAHLGDAFSMNHIDVSCCTKSGCNH
PDLDVQYRSGAAPQPGPAHLSLTITLL-
MTARLWGGTLLWT corresponding to amino acids 56-335 of UPAR-HUMAN (SEQ ID NO:593), which also corresponds to amino acids 61-340 of HSUPARAA_P7 (SEQ ID NO:228), wherein said first amino acid sequence, second amino acid sequence and third amino acid sequence are contiguous and in a sequential order.

B. An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSUPARAA_P7 (SEQ ID NO:228).

2. Comparison Report Between HSUPARAA_P7 (SEQ ID NO:228) and NP_002650 (SEQ ID NO:217):

A. An isolated chimeric polypeptide encoding for HSUPARAA_P7 (SEQ ID NO:228), comprising a first amino acid sequence being at least 90% homologous to MGHPPLL-PLLLLLHTCVPASWGLRCMQCKTNGD-CRVEECALGQDLCRTTIVRLWE corresponding to amino acids 1-55 of NP_002650 (SEQ ID NO:217), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), and a third amino acid sequence being at least 90% homologous to EGEELELVEK-SCTHSEKTNRTLSYRTGLKITSLTEV-
VCGLDLCNQGNSGRAVTYSRSRYLE CISCGSSDM-SCERGRHQSLQCRSPEEQCLDVVTHWIQEGEEGRPK DDRHLRGCGYLPGCP GSNGFHNNDTFHFLKCCNTT-KCNEGPILELENLPQNGRQCYSCKGN-
STHGCSSEETFLIDC RGPMNQCLVATGTHEPKN-QSYMVRGCATASMCQHAHLGDAFSMNHIDVSCCTK SGCNH PDLDVQYRSGAAPQPGPAHLSLTITLL-MTARLWGGTLLWT corresponding to amino acids 56-335 of NP_002650 (SEQ ID NO:217), which also corresponds to amino acids 61-340 of HSUPARAA_P7 (SEQ ID NO:228), wherein said first amino acid sequence, second amino acid sequence and third amino acid sequence are contiguous and in a sequential order.

B. An isolated polypeptide encoding for an edge portion of HSUPARAA P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSUPARAA_P7 (SEQ ID NO:228).

3. Comparison Report Between HSUPARAA_P7 (SEQ ID NO:228) and Q9BWT0_HUMAN (SEQ ID NO:223):

A. An isolated chimeric polypeptide encoding for HSUPARAA_P7 (SEQ ID NO:228), comprising a first amino acid sequence being at least 90% homologous to MGHPPLL-PLLLLLHTCVPASWGLRCMQCKTNGD-CRVEECALGQDLCRTTWRLWE corresponding to amino acids 1-55 of Q9BWT0_HUMAN (SEQ ID NO:223), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), a third amino acid sequence being at least 90% homologous to EGEELELVEK-SCTHSEKTNRTLSYRTGLKITSLTEV-
VCGLDLCNQGNSGRAVTYSRSRYLE CISCGSSDM-SCERGRHQSLQCRSPEEQCLDVVTHWIQEGEEGRPK DDR corresponding to amino acids 56-164 of Q9BWT0_HUMAN (SEQ ID NO:223), which also corresponds to amino acids 61-169 of HSUPARAA_P7 (SEQ ID NO:228), a bridging amino acid H corresponding to amino acid 170 of HSUPARAA_P7 (SEQ ID NO:228), a fourth amino acid sequence being at least 90% homologous to LRGCGYLPGCPGSNGFHNNDTFHFLKC-
CNTTKCNEGPILELENLPQNGRQCYSCKGNSTH GCS-SEETFLIDCRGPMNQCLVATGTHEPKN-
QSYMVRGCATASMCQHAHLGDAFSMNHID VSCCTKSGCNHPDLDVQ corresponding to amino acids 166-301 of Q9BWT0_HUMAN (SEQ ID NO:223), which also corresponds to amino acids 171-306 of HSUPARAA_P7 (SEQ ID NO:228), and a fifth amino acid sequence being at least 70%, optionally at least 80%, preferably at least 85%, more preferably at least 90% and most preferably at least 95% homologous to a polypeptide having the sequence YRS-GAAPQPGPAHLSLTITLLMTARLWGGTLLWT (SEQ ID NO:563) corresponding to amino acids 307-340 of HSUPARAA_P7 (SEQ ID NO:228), wherein said first amino acid sequence, second amino acid sequence, third amino acid sequence, bridging amino acid, fourth amino acid sequence and fifth amino acid sequence are contiguous and in a sequential order.

B. An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSUPARAA_P7 (SEQ ID NO:228).

C. An isolated polypeptide encoding for a tail of HSUPARAA_P7 (SEQ ID NO:228), comprising a polypeptide being at least 70%, optionally at least about 80%, preferably at least about 85%, more preferably at least about 90% and most preferably at least about 95% homologous to the sequence YRSGAAPQPGPAHLSLTITLLMTARLWG-GTLLWT (SEQ ID NO:563) of HSUPARAA_P7 (SEQ ID NO:228).

4. Comparison Report Between HSUPARAA_P7 (SEQ ID NO:228) and Q03405-3 (SEQ ID NO:220):

A. An isolated chimeric polypeptide encoding for HSUPARAA_P7 (SEQ ID NO:228), comprising a first amino acid sequence being at least 90% homologous to MGHPPLL-PLLLLLHTCVPASWGLRCMQCKTNGD-
CRVEECALGQDLCRTTIVRLWE corresponding to amino acids 1-55 of Q03405-3 (SEQ ID NO:220), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), a third amino acid sequence being at least 90% homologous to EGEELELVEKSCTH-SEKTNRTLSYRTGLKITSLTEVVCGLDL-
CNQGNSGRAVTYSRSRYLE CISCGSSDMSCER-GRHQSLQCRSPEEQCLDVVTHWIQEGEE corresponding to amino acids 56-157 of Q03405-3 (SEQ ID NO:220), which also corresponds to amino acids 61-162 of HSUPARAA_P7 (SEQ ID NO:228), a fourth amino acid sequence being at least 70%, optionally at least 80%, preferably at least 85%, more preferably at least 90% and most preferably at least 95% homologous to a polypeptide having the sequence GRPKDDRHLRGCGYLPGCPGSNGF-HNNDTFHFLKCCNTTKCNEGP (SEQ ID NO:564) corresponding to amino acids 163-207 of HSUPARAA_P7 (SEQ ID NO:228), and a fifth amino acid sequence being at least 90% homologous to ILELENLPQNGRQCYSCKGNSTH-GCSSEETFLIDCRGPMNQCLVATGTHEP-KNQSYMVRG CATASMCQHAHLGDAFSMNHIDVSC-CTKSGCNHPDLDVQYRSGAAPQPGPAHLSLTITLL MTARLWGGTLLWT corresponding to amino acids 158-290 of Q03405-3 (SEQ ID NO:220), which also corresponds to amino acids 208-340 of HSUPARAA_P7 (SEQ ID NO:228), wherein said first amino acid sequence, second amino acid sequence, third amino acid sequence, fourth amino acid sequence and fifth amino acid sequence are contiguous and in a sequential order.

B. An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSUPARAA_P7 (SEQ ID NO:228).

C. An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGP (SEQ ID NO:564) of HSUPARAA_P7 (SEQ ID NO:228).

5. Comparison Report Between HSUPARAA_P7 (SEQ ID NO:228) and NP_001005377 (SEQ ID NO:221):

A. An isolated chimeric polypeptide encoding for HSUPARAA_P7 (SEQ ID NO:228), comprising a first amino acid sequence being at least 90% homologous to MGHPPLL-PLLLLLHTCVPASWGLRCMQCKTNGD-CRVEECALGQDLCRTTIVRLWE corresponding to amino acids 1-55 of NP_001005377 (SEQ ID NO:221), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), a third amino acid sequence being at least 90% homologous to EGEELELVEK-SCTHSEKTNRTLSYRTGLKITSLTEV-VCGLDLCNQGNSGRAVTYSRSRYLE CISCGSSDM-SCERGRHQSLQCRSPEEQCLDVVTHWIQEGEE corresponding to amino acids 56-157 of NP_001005377 (SEQ ID NO:221), which also corresponds to amino acids 61-162 of HSUPARAA_P7 (SEQ ID NO:228), a fourth amino acid sequence being at least 70%, optionally at least 80%, preferably at least 85%, more preferably at least 90% and most preferably at least 95% homologous to a polypeptide having the sequence GRPKDDRHLRGCGYLPGCPG-SNGFHNNDTFHFLKCCNTTKCNEGPI (SEQ ID NO:565) corresponding to amino acids 163-208 of HSUPARAA_P7 (SEQ ID NO:228), and a fifth amino acid sequence being at least 90% homologous to LELENLPQN-GRQCYSCKGNSTHGCSSEETFLIDCRGP-MNQCLVATGTHEPKNQSYMVRG CATASMCQHAHL-GDAFSMNHIDVSCCTKSGCNBPDLDVQYRSGAAPQP GPAHLSLTITLL MTARLWGGTLLWT corresponding to amino acids 159-290 of NP_001005377 (SEQ ID NO:221), which also corresponds to amino acids 209-340 of HSUPARAA_P7 (SEQ ID NO:228), wherein said first amino acid sequence, second amino acid sequence, third amino acid sequence, fourth amino acid sequence and fifth amino acid sequence are contiguous and in a sequential order.

B. An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSUPARAA_P7 (SEQ ID NO:228).

C. An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGPI (SEQ ID NO:565) of HSUPARAA_P7 (SEQ ID NO:228).

D. A bridge portion of HSUPARAA_P7 (SEQ ID NO:228), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows (numbering according to HSUPARAA_P7): a sequence starting from any of amino acid numbers 157-x to 157; and ending at any of amino acid numbers 158+((n−2)−x), in which x varies from 0 to n−2.

A bridge portion of HSUPARAA_P7 (SEQ ID NO:228), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IL, having a structure as follows (numbering according to HSUPARAA_P7): a sequence starting from any of amino acid numbers 208-x to 208; and ending at any of amino acid numbers 209+((n−2)−in which x varies from 0 to n−2.

6. Comparison Report Between HSUPARAA_P7 (SEQ ID NO:228) and Q9UP15_HUMAN (SEQ ID NO:218):

A. An isolated chimeric polypeptide encoding for HSUPARAA_P7 (SEQ ID NO:228), comprising a first amino acid sequence being at least 90% homologous to MGHPPLL-PLLLLLHTCVPASWGLRCMQCKTNGD-CRVEECALGQDLCRTTWRLWE corresponding to amino acids 1-55 of Q9UPI5-HUMAN (SEQ ID NO:218), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), a third amino acid sequence being at least 90% homologous to EGEELELVEK-SCTHSEKTNRTLSYRTGLKITSLTEV-VCGLDLCNQGNSGRAVTYSRSRYLE CISCGSSDM-SCERGPHQSLQCRSPEEQCLDVVTHWIQEGEEGRPK DDRHLRGCGYLPGCP GSNGFHNNDTFHFLKCCNTT-KCNEGPILELENLPQNGRQCYSCKGN- STHGCSSEETFLIDC RGPMNQCLVATGTH corresponding to amino acids 56-251 of Q9UPI5_HUMAN (SEQ ID NO:218), which also corresponds to amino acids 61-256 of HSUPARAA_P7 (SEQ ID NO:228), and a fourth amino acid sequence being at least 70%, optionally at least 80%, preferably at least 85%, more preferably at least 90% and most preferably at least 95% homologous to a polypeptide having the sequence EPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:566) corresponding to amino acids 257-340 of HSUPARAA_P7 (SEQ ID NO:228), wherein said first amino acid sequence, second amino acid sequence, third amino acid sequence and fourth amino acid sequence are contiguous and in a sequential order.

B. An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSUPARAA_P7 (SEQ ID NO:228).

C. An isolated polypeptide encoding for a tail of HSUPARAA_P7 (SEQ ID NO:228), comprising a polypeptide being at least 70%, optionally at least about 80%, preferably at least about 85%, more preferably at least about 90% and most preferably at least about 95% homologous to the sequence EPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:566) of HSUPARAA_P7 (SEQ ID NO:228).

7. Comparison Report Between HSUPARAA_P7 (SEQ ID NO:228) and NP_001005376 (SEQ ID NO:222):

A. An isolated chimeric polypeptide encoding for HSUPARAA_P7 (SEQ ID NO:228), comprising a first amino acid sequence being at least 90% homologous to MGHPPLLPLLLLLHTCVPASWGLRCMQCKTNGD-CRVEECALGQDLCRTTWRLWE corresponding to amino acids 1-55 of NP_001005376 (SEQ ID NO:222), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), a third amino acid sequence being at least 90% homologous to EGEELELVEKSCTHSEKTNRTLSYRTGLKITSLTEV-VCGLDLCNQGNSGRAVTYSRSRYLE CISCGSSDMSCERGRHQSLQCRSPEEQCLDVVTHWIQEGEEGRPKDDRHLRGCGYLPGCP GSNGFHNNDTFHFLKCCNTTKCNEGPILELENLPQNGRQCYSCKGN-STHGCSSEETFLIDC RGPMNQCLVATGTHE corresponding to amino acids 56-252 of NP_001005376 (SEQ ID NO:222), which also corresponds to amino acids 61-257 of HSUPARAA_P7 (SEQ ID NO:228), and a fourth amino acid sequence being at least 70%, optionally at least 80%, preferably at least 85%, more preferably at least 90% and most preferably at least 95% homologous to a polypeptide having the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) corresponding to amino acids 258-340 of HSUPARAA_P7 (SEQ ID NO:228), wherein said first amino acid sequence, second amino acid sequence, third amino acid sequence and fourth amino acid sequence are contiguous and in a sequential order.

B. An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSUPARAA_P7 (SEQ ID NO:228).

C. An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) of HSUPARAA_P7 (SEQ ID NO:228).

8. Comparison Report Between HSUPARAAAP7 (SEQ ID NO:228) and Q03405-2 (SEQ ID NO:219):

A. An isolated chimeric polypeptide encoding for HSUPARAA_P7 (SEQ ID NO:228), comprising a first amino acid sequence being at least 90% homologous to MGHPPLLPLLLLLHTCVPASWGLRCMQCKTNGD-CRVEECALGQDLCRTTIVRLWE corresponding to amino acids 1-55 of Q03405-2 (SEQ ID NO:219), which also corresponds to amino acids 1-55 of HSUPARAA_P7 (SEQ ID NO:228), a second amino acid sequence being at least 70%, optionally at least 80%, preferably at least 85%, more preferably at least 90% and most preferably at least 95% homologous to a polypeptide having the sequence DPLLA (SEQ ID NO:562) corresponding to amino acids 56-60 of HSUPARAA_P7 (SEQ ID NO:228), a third amino acid sequence being at least 90% homologous to EGEELELVEKSCTHSEKTNRTLSYRTGLKITSLTEVVCGLDL-CNQGNSGRAVTYSRSRYLE CISCGSSDMSCER-GRHQSLQCRSPEEQCLDVVTHWIQEGEEGRPKDDRH LRGCGYLPGCP GSNGFHNNDTFHFLKCCNTTKC-NEGPILELENLPQNGRQCYSCKGNSTH-GCSSEETFLIDC RGPMNQCLVATGTHE corresponding to amino acids 56-252 of Q03405-2 (SEQ ID NO:219), which also corresponds to amino acids 61-257 of HSUPARAA_P7 (SEQ ID NO:228), and a fourth amino acid sequence being at least 70%, optionally at least 80%, preferably at least 85%, more preferably at least 90% and most preferably at least 95% homologous to a polypeptide having the sequence PKNQSYMVRGCATASMCQHAHLGDAFSMN-HIDVSCCTKSGCNHPDLDVQYRSGAAPQP GPAHLSL-TITLLMTARLWGGTLLWT (SEQ ID NO:567) corresponding to amino acids 258-340 of HSUPARAA_P7 (SEQ ID NO:228), wherein said first amino acid sequence, second amino acid sequence, third amino acid sequence and fourth amino acid sequence are contiguous and in a sequential order.

B. An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence DPLLA (SEQ ID NO:562) of HSUPARAA_P7 (SEQ ID NO:228).

C. An isolated polypeptide encoding for an edge portion of HSUPARAA_P7 (SEQ ID NO:228), comprising an amino acid sequence being at least 70%, optionally at least about 80%, preferably at least about 85%, more preferably at least about 90% and most preferably at least about 95% homologous to the sequence PKNQSYMVRGCATASMCQHAHLGDAFSMNHIDVSCCTKSGCNHPDLDVQYRSGAAPQPGPAHLSLTITLLMTARLWGGTLLWT (SEQ ID NO:567) of HSUPARAA_P7 (SEQ ID NO:8).

The localization of the variant protein was determined according to results from a number of different software programs and analyses, including analyses from SignalP and other specialized programs. The variant protein is believed to be located as follows with regard to the cell: membrane.

Variant protein HSUPARAA_P7 (SEQ ID NO:228) also has the following non-silent SNPs (Single Nucleotide Polymorphisms) as listed in Table 223, (given according to their position(s) on the amino acid sequence, with the alternative amino acid(s) listed; the last column indicates whether the SNP is known or not; the presence of known SNPs in variant protein HSUPARAA_P7 (SEQ ID NO:228) sequence provides support for the deduced sequence of this variant protein according to the present invention).

TABLE 223

Amino acid mutations

| SNP position(s) on amino acid sequence | Alternative amino acid(s) | Previously known SNP? |
|---|---|---|
| 17 | V -> | No |
| 55 | E -> G | Yes |
| 83 | S -> N | No |
| 91 | T -> A | Yes |
| 105 | Q -> | No |
| 110 | R -> Q | Yes |
| 176 | Y -> * | No |
| 176 | Y -> | No |
| 189 | N -> D | No |
| 198 | C -> R | No |
| 200 | T -> S | No |
| 217 | N -> S | No |
| 225 | K -> R | Yes |
| 247 | N -> S | No |
| 259 | K -> * | No |
| 286 | N -> K | Yes |
| 302 | D -> A | Yes |
| 311 | A -> | No |
| 311 | A -> S | No |
| 322 | L -> P | Yes |
| 325 | T -> I | No |
| 340 | T -> S | No |

The glycosylation sites of variant protein HSUPARAA_P7 (SEQ ID NO:228), as compared to the known protein Urokinase plasminogen activator surface receptor precursor (SEQ ID NO:216), are described in Table 224 (given according to their position(s) on the amino acid sequence in the first column; the second column indicates whether the glycosylation site is present in the variant protein; and the last column indicates whether the position is different on the variant protein).

TABLE 224

Glycosylation site(s)

| Position(s) on known amino acid sequence | Present in variant protein? | Position(s) on variant protein |
|---|---|---|
| 79 | Yes | 79 |
| 189 | Yes | 189 |
| 199 | Yes | 199 |
| 227 | Yes | 227 |
| 260 | Yes | 260 |

The variant protein has the following domains, as determined by using InterPro. The domains are described in Table 225:

TABLE 225

| InterPro domain(s) | | |
|---|---|---|
| Domain description | Analysis type | Position(s) on protein |
| Urokinase plasminogen activator surface receptor | BlastProDom | 14-113 |
| CD59 antigen | HMMPfam | 23-105, 220-300 |
| CD59 antigen | HMMSmart | 23-115, 120-212, 219-306 |
| CD59 antigen | ScanRegExp | 121-174, 220-274 |

Variant protein HSUPARAA_P7 (SEQ ID NO:228) is encoded by the following transcript(s): HSUPARAA_T10 (SEQ ID NO:181), for which the sequence(s) is/are given at the end of the application. The coding portion of transcript HSUPARAA_T10 (SEQ ID NO:181) is shown in bold; this coding portion starts at position 428 and ends at position 1447. The transcript also has the following SNPs as listed in Table 226 (given according to their position on the nucleotide sequence, with the alternative nucleic acid listed; the last column indicates whether the SNP is known or not; the presence of known SNPs in variant protein HSUPARAA_P7 (SEQ ID NO:228) sequence provides support for the deduced sequence of this variant protein according to the present invention).

TABLE 226

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 664 | C -> T | Yes |
| 675 | G -> A | No |
| 698 | A -> G | Yes |
| 742 | G -> | No |
| 756 | G -> A | Yes |
| 916 | G -> A | No |
| 955 | C -> A | No |
| 955 | C -> | No |
| 992 | A -> G | No |
| 1019 | T -> C | No |
| 1026 | C -> G | No |
| 1077 | A -> G | No |
| 1101 | A -> G | Yes |
| 1101 | -> G | No |
| 1167 | A -> G | No |
| 1175 | C -> T | No |
| 1186 | C -> T | Yes |
| 1195 | C -> T | Yes |
| 1202 | A -> T | No |
| 1237 | C -> T | Yes |
| 1285 | C -> A | Yes |
| 1332 | A -> C | Yes |
| 1358 | G -> | No |
| 1358 | G -> T | No |
| 1375 | C -> G | No |
| 1392 | T -> C | Yes |
| 1401 | C -> T | No |
| 1438 | C -> A | Yes |

TABLE 226-continued

Nucleic acid SNPs

| SNP position(s) on nucleotide sequence | Alternative nucleic acid(s) | Previously known SNP? |
|---|---|---|
| 1445 | A -> T | No |
| 1489 | G -> A | Yes |
| 1491 | C -> A | No |
| 1491 | C -> | No |
| 1508 | C -> T | Yes |
| 1556 | G -> A | Yes |
| 1563 | C -> T | No |
| 1612 | G -> C | Yes |
| 1641 | G -> | No |

Variant protein HSUPARAA_P8 (SEQ ID NO:229) according to the present invention has an amino acid sequence as given at the end of the application; it is encoded by transcript(s) HSUPARAA_T 1I (SEQ ID NO:182). An alignment is given to the known protein (Urokinase plasminogen activator surface receptor precursor (SEQ ID NO:216)) at the end of the application. One or more alignments to one or more previously published protein sequences are given at the end of the application. A brief description of the relationship of the variant protein according to the present invention to each such aligned protein is as follows:

1. Report Between HSUPARAA_P8 (SEQ ID NO: 229) and UPAR_HUMAN (SEQ ID NO:593):

A. An isolated chimeric polypeptide encoding for HSUPARAA_P8 (SEQ ID NO:229), comprising a first amino acid sequence being at least 90% homologous to MGHPPLLPLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQE corresponding to amino acids 1-154 of UPAR_HUMAN (SEQ ID NO:593), which also corresponds to amino acids 1-154 of HSUPARAA_P8 (SEQ ID NO:229), and a second amino acid sequence being at least 90% homologous to GRPKDDRHLRGCGYLPGCPGSNGF-HNNDTFHFLKCCNTTKCNEGPILELENLPQNGRQCY SCKGNSTHGCSSEETFLIDCRGPMNQ-CLVATGTHEPKNQSYMVRGCATASMCQHAHLGD AFSMNHIDVSCCTKSGCNHPDLDVQ-IRSGAAPQPG-PAHLSLTITLLMTARLWGGTLLWT corresponding to amino acids 158-335 of UPAR_HUMAN (SEQ ID NO:593), which also corresponds to amino acids 155-332 of HSUPARAA_P8 (SEQ ID NO:229), wherein said first amino acid sequence and second amino acid sequence are contiguous and in a sequential order.

B. An isolated chimeric polypeptide encoding for an edge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 154-x to 154; and ending at any of amino acid numbers 155+((n−2)−x), in which x varies from 0 to n-2.

2. Comparison Report Between HSUPARAA_P8 (SEQ ID NO:229) and NP_002650 (SEQ ID NO:217):

A. An isolated chimeric polypeptide encoding for HSUPARAA_P8 (SEQ ID NO:229), comprising a first amino acid sequence being at least 90% homologous to MGHPPLLPLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQE corresponding to amino acids 1-154 of NP_002650 (SEQ ID NO:217), which also corresponds to amino acids 1-154 of HSUPARAA_P8 (SEQ ID NO:229), and a second amino acid sequence being at least 90% homologous to GRPKDDRHLRGCGYLPGCPGSNGF-HNNDTFHFLKCCNTTKCNEGPILELENLPQNGRQCY SCKGNSTHGCSSEETFLIDCRGPMNQ-CLVATGTHEPKNQSYMVRGCATASMCQHAHLGD AFSMNHIDVSCCTKSGCNHPDLDVQYRS-GAAPQPGPAHLSLTITLLMTARLWGGTLLWT corresponding to amino acids 158-335 of NP_002650 (SEQ ID NO:217), which also corresponds to amino acids 155-332 of HSUPARAA_P8 (SEQ ID NO:229), wherein said first amino acid sequence and second amino acid sequence are contiguous and in a sequential order.

B. An isolated chimeric polypeptide encoding for an edge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 154-x to 154; and ending at any of amino acid numbers 155+((n−2)−x), in which x varies from 0 to n-2.

3. Comparison report between HSUPARAA_P8 (SEQ ID NO:229) and Q9BWT0_-HUMAN (SEQ ID NO:223):

A. An isolated chimeric polypeptide encoding for HSUPARAA_P8 (SEQ ID NO:229), comprising a first amino acid sequence being at least 90% homologous to MGHPPLLPLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQE corresponding to amino acids 1-154 of Q9BWT0_HUMAN (SEQ ID NO:223), which also corresponds to amino acids 1-154 of HSUPARAA_P8 (SEQ ID NO:229), a second amino acid sequence being at least 90% homologous to GRPKDDR corresponding to amino acids 158-164 of Q9BWT0_HUMAN (SEQ ID NO:223), which also corresponds to amino acids 155-161 of HSUPARAA_P8 (SEQ ID NO:229), a bridging amino acid H corresponding to amino acid 162 of HSUPARAA_P8 (SEQ ID NO:229), a third amino acid sequence being at least 90% homologous to LRGCGYLPGCPGSNGFHNNDTFHFLKC-CNTTKCNEGPILELENLPQNGRQCYSCKGNSTH GCS-SEETFLIDCRGPMNQCLVATGTHEPKN-QSYMVRGCATASMCQHAHLGDAFSMNHID VSCCTKSGCNHPDLDVQ corresponding to amino acids 166-301 of Q9BWT0_HUMAN (SEQ ID NO:223), which also corresponds to amino acids 163-298 of HSUPARAA_P8 (SEQ ID NO:229), and a fourth amino acid sequence being at least 70%, optionally at least 80%, preferably at least 85%, more preferably at least 90% and most preferably at least 95% homologous to a polypeptide having the sequence YRS-GAAPQPGPAHLSLTITLLMTARLWGGTLLWT (SEQ ID NO:563) corresponding to amino acids 299-332 of HSUPARAA_P8 (SEQ ID NO:229), wherein said first amino acid sequence, second amino acid sequence, bridging amino acid, third amino acid sequence and fourth amino acid sequence are contiguous and in a sequential order.

B. An isolated chimeric polypeptide encoding for an edge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 154-x to 154; and ending at any of amino acid numbers 155+((n−2)−x), in which x varies from 0 to n−2.

C. An isolated polypeptide encoding for a tail of HSUPARAA_P8 (SEQ ID NO:229), comprising a polypeptide being at least 70%, optionally at least about 80%, preferably at least about 85%, more preferably at least about 90% and most preferably at least about 95% homologous to the sequence YRSGAAPQPGPAHLSLTITLLMTARLWGGTLLWT (SEQ ID NO:563) of HSUPARAA_P8 (SEQ ID NO:229).

4. Comparison Report Between HSUPARAA_P8 (SEQ ID NO:229) and Q03405-3 (SEQ ID NO:220):

A. An isolated chimeric polypeptide encoding for HSUPARAA_P8 (SEQ ID NO:229), comprising a first amino acid sequence being at least 90% homologous to MGHPPLLPLLLLLHTCVPASWGLRCMQCKTNGDCRVEECALGQDLCRTTIVRLWEEGEE LELVEKSCTHSEKTNRTLSYRTGLKITSLTEVVCGLDLCNQGNSGRA VTYSRSRYLECISC GSSDMSCERGRHQSLQCRSPEEQCLDVVTHWIQEG corresponding to amino acids 1-155 of Q03405-3 (SEQ ID NO:220), which also corresponds to amino acids 1-155 of HSUPARAA_P8 (SEQ ID NO:229), a second amino acid sequence being at least 70%, optionally at least 80%, preferably at least 85%, more preferably at least 90% and most preferably at least 95% homologous to a polypeptide having the sequence RPKDDRHLRGCGYLPGCPGSNGFHNNDTFHFLKCCNTTKCNEGP (SEQ ID NO:569) corresponding to amino acids 156-199 of HSUPARAA_P8 (SEQ ID NO:229), and a third amino acid sequence being at least 90% homologous to ILELENLPQNGRQCYSCKGNSTHGCSSEETFLIDCRGP-MNQCLVATGTHEPKNQSYMVRG CATASMCQHAHLGDAFSMNHIDVSCCTKSGCNIHPDLDVQYRSGAAPQ PGPAHLSLTITLL MTARLWGGTLLWT corresponding to amino acids 158-290 of Q03405-3 (SEQ ID NO:220), which also corresponds to amino acids 200-332 of HSUPARAA_P8 (SEQ ID NO:229), wherein said first amino acid sequence, second amino acid sequence and third amino acid sequence are contiguous and in a sequential order.

B. An isolated polypeptide encoding for an edge portion of HSUPARAA_P8 (SEQ ID NO:229), comprising an amino acid sequence being at least 70%, optionally at least about 80%, preferably at least about 85%, more preferably at least about 90% and most preferably at least about 95% homologous to the sequence RPKDDRHLRGCGYLPGCPGSNGFHNNDTFHFLKCCNTTKCNEGP (SEQ ID NO:569) of HSUPARAA_P8 (SEQ ID NO:229).

C. A bridge portion of HSUPARAAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise GR, having a structure as follows (numbering according to HSUPARAA_P8): a sequence starting from any of amino acid numbers 155-x to 155; and ending at any of amino acid numbers 156+((n−2)−x), in which x varies from 0 to n−2.

A bridge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IL, having a structure as follows (numbering according to HSUPARAA_P8): a sequence starting from any of amino acid numbers 200-x to 200; and ending at any of amino acid numbers 201+((n−2)−x), in which x varies from 0 to n−2.

5. Comparison Report Between HSUPARAA_P8 (SEQ ID NO:229) and NP_001005377 (SEQ ID NO:221):

A. An isolated chimeric polypeptide encoding for HSUPARAA_P8 (SEQ ID NO:229), comprising a first amino acid sequence being at least 90% homologous to MGHPPLLPLLLLLHTCVPASWGLRCMQCKTNGDCRVEECALGQDLCRTTIVRLWEEGEE LELVEKSCTHSEKTNRTLSYRTGLKITSLTEVVCGLDLCNQGNSGRA VTYSRSRYLECISC GSSDMSCERGRHQSLQCRSPEEQCLDVVTHWIQEG corresponding to amino acids 1-155 of NP_001005377 (SEQ ID NO:221), which also corresponds to amino acids 1-155 of HSUPARAA_P8 (SEQ ID NO:229), a second amino acid sequence being at least 70%, optionally at least 80%, preferably at least 85%, more preferably at least 90% and most preferably at least 95% homologous to a polypeptide having the sequence RPKDDRHLRGCGYLPGCPGSNGFHNNDTFHFLKCCNTTKCNEGPI (SEQ ID NO:570) corresponding to amino acids 156-200 of HSUPARAA_P8 (SEQ ID NO:229), and a third amino acid sequence being at least 90% homologous to LELENLPQNGRQCYSCKGNSTHGCSSEETFLIDCRGP-MNQCLVATGTHEPKNQSYMVRG CATASMCQHAHLGDAFSMNHIDVSCCTKSGCNHPDLDVQYRSGAAPQP GPAHLSLTITLL MTARLWGGTLLWT corresponding to amino acids 159-290 of NP_001005377 (SEQ ID NO:221), which also corresponds to amino acids 201-332 of HSUPARAA_P8 (SEQ ID NO:229), wherein said first amino acid sequence, second amino acid sequence and third amino acid sequence are contiguous and in a sequential order.

B. An isolated polypeptide encoding for an edge portion of HSUPARAA_P8 (SEQ ID NO:229), comprising an amino acid sequence being at least 70%, optionally at least about 80%, preferably at least about 85%, more preferably at least about 90% and most preferably at least about 95% homologous to the sequence RPKDDRHLRGCGYLPGCPGSNGFHNNDTFHFLKCCNTTKCNEGPI (SEQ ID NO:570) of HSUPARAA_P8 (SEQ ID NO:229).

C. A bridge portion of HSUPARAAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise GR, having a structure as follows (numbering according to HSUPARAA_P8): a sequence starting from any of amino acid numbers 155-x to 155; and ending at any of amino acid numbers 156 +((n−2)−x), in which x varies from 0 to n−2.

A bridge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IL, having a structure as follows (numbering according to HSU-PARAAAP8): a sequence starting from any of amino acid numbers 200-x to 200; and ending at any of amino acid numbers 201 +((n-2) -x), in which x varies from 0 to n-2.

6. Comparison Report Between HSUPARAA_P8 (SEQ ID NO:229) and Q9UPI5_HUMAN (SEQ ID NO:218):

A. An isolated chimeric polypeptide encoding for HSUPARAA_P8 (SEQ ID NO:229), comprising a first amino acid sequence being at least 90% homologous to MGHPPLLPLLLLLHTCVPASWGLRCMQCKTNGD-CRVEECALGQDLCRTTIRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQE corresponding to amino acids 1-154 of Q9UPI5_HUMAN (SEQ ID NO:218), which also corresponds to amino acids 1-154 of HSUPARAA_P8 (SEQ ID NO:229), a second amino acid sequence being at least 90% homologous to GRPKDDRHLRGCGYLPGCPGSNGF-HNNDTFHFLKCCNTTKCNEGPILELENLPQNGRQCY SCKGNSTHGCSSEETFLIDCRGPMNQCLVATGTH corresponding to amino acids 158-251 of Q9UPI5_HUMAN (SEQ ID NO:218), which also corresponds to amino acids 155-248 of HSUPARAA_P8 (SEQ ID NO:229), and a third amino acid sequence being at least 70%, optionally at least 80%, preferably at least 85%, more preferably at least 90% and most preferably at least 95% homologous to a polypeptide having the sequence EPKNQSYMVRGCATASMC-QHAHLGDAFSMNHIDVSCCTKSGCNHP-DLDVQYRSGAAPQ PGPAHLSLTITLLMTARLWGGTLLWT (SEQ ID NO:566) corresponding to amino acids 249-332 of HSUPARAA_P8 (SEQ ID NO:229), wherein said first amino acid sequence, second amino acid sequence and third amino acid sequence are contiguous and in a sequential order.

B. An isolated chimeric polypeptide encoding for an edge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 154-x to 154; and ending at any of amino acid numbers 155+((n−2)−x), in which x varies from 0 to n-2.

C. An isolated polypeptide encoding for a tail of HSUPARAA_P8 (SEQ ID NO:229), comprising a polypeptide being at least 70%, optionally at least about 80%, preferably at least about 85%, more preferably at least about 90% and most preferably at least about 95% homologous to the sequence EPKNQSYMVRGCATASMCQHAHLGDAF-SMNHIDVSCCTKSGCNHPDLDVQYRSGAAPQ PGPAHLSLTITLLMTARLWGGTLLWT (SEQ ID NO:566) of HSUPARAA_P8 (SEQ ID NO:229).

7. Comparison Report Between HSUPARAA_P8 (SEQ ID NO:229) and NP_001005376 (SEQ ID NO:222):

A. An isolated chimeric polypeptide encoding for HSUPARAA_P8 (SEQ ID NO:229), comprising a first amino acid sequence being at least 90% homologous to MGHPPLLPLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQE corresponding to amino acids 1-154 of NP_001005376 (SEQ ID NO:222), which also corresponds to amino acids 1-154 of HSUPARAA_P8 (SEQ ID NO:229), a second amino acid sequence being at least 90% homologous to GRPKDDRHLRGCGYLPGCPGSNGF-HNNDTFHFLKCCNTTKCNEGPILELENLPQNGRQCY SCKGNSTHGCSSEETFLIDCRGPMNQCLVATGTHE corresponding to amino acids 158-252 of NP_001005376 (SEQ ID NO:222), which also corresponds to amino acids 155-249 of HSUPARAA_P8 (SEQ ID NO:229), and a third amino acid sequence being at least 70%, optionally at least 80%, preferably at least 85%, more preferably at least 90% and most preferably at least 95% homologous to a polypeptide having the sequence PKNQSYMVRGCATASMC-QHAHLGDAFSMNHIDVSCCTKSGCNHP-DLDVQYRSGAAPQP GPAHLSLTITLLMTARLWGGTLLWT (SEQ ID NO:567) corresponding to amino acids 250-332 of HSUPARAA_P8 (SEQ ID NO:229), wherein said first amino acid sequence, second amino acid sequence and third amino acid sequence are contiguous and in a sequential order.

B. An isolated chimeric polypeptide encoding for an edge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 154-x to 154; and ending at any of amino acid numbers 155+((n−2)−x), in which x varies from 0 to n-2.

C. An isolated polypeptide encoding for an edge portion of HSUPARAA_P8 (SEQ ID NO:229), comprising an amino acid sequence being at least 70%, optionally at least about 80%, preferably at least about 85%, more preferably at least about 90% and most preferably at least about 95% homologous to the sequence PKNQSYMVRGCATASMCQHAHL-GDAFSMNHIDVSCCTKSGCNHPDLDVQYRSGAAPQP GPAHLSLTITLLMTARLWGGTLLWT (SEQ ID NO:567) of HSUPARAA_P8 (SEQ ID NO:229).

8. Comparison Report Between HSUPARAA_P8 (SEQ ID NO:229) and Q03405-2 (SEQ ID NO:219):

A. An isolated chimeric polypeptide encoding for HSUPARAA_P8 (SEQ ID NO:229), comprising a first amino acid sequence being at least 90% homologous to MGHPPLLPLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQE corresponding to amino acids 1-154 of Q03405-2 (SEQ ID NO:219), which also corresponds to amino acids 1-154 of HSUPARAA_P8 (SEQ ID NO:229), a second amino acid sequence being at least 90% homologous to B0493870; 1) GRPKDDRHLRGCGYLPGCPGSNGF-HNNDTFHFLKCCNTTKCNEGPILELENLPQNGRQCY SCKGNSTHGCSSEETFLIDCRGPMNQCLVATGTHE corresponding to amino acids 158-252 of Q03405-2 (SEQ ID NO:219), which also corresponds to amino acids 155-249 of HSUPARAA_P8 (SEQ ID NO:229), and a third amino acid sequence being at least 70%, optionally at least 80%, preferably at least 85%, more preferably at least 90% and most preferably at least 95% homologous to a polypeptide having the sequence PKNQSYMVRGCATASMCQHAHLGDAF-SMNHIDVSCCTKSGCNHPDLDVQYRSGAAPQP GPAHLSLTITLLMTARLWGGTLLWT (SEQ ID NO:567) corresponding to amino acids 250-332 of HSUPARAA_P8

(SEQ ID NO:229), wherein said first amino acid sequence, second amino acid sequence and third amino acid sequence are contiguous and in a sequential order.

B. An isolated chimeric polypeptide encoding for an edge portion of HSUPARAA_P8 (SEQ ID NO:229), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 154-x to 154; and ending at any of amino acid numbers 155+((n−2)−x), in which x varies from 0 to n-2.

C. An isolated polypeptide encoding for an edge portion of HSUPARAA_P8 (SEQ ID NO:229), comprising an amino acid sequence being at least 70%, optionally at least about 80%, preferably at least about 85%, more preferably at least about 90% and most preferably at least about 95% homologous to the sequence PKNQSYMVRGCATASMCQHAHL-GDAFSMNHIDVSCCTKSGCNHPDLDVQYRSGAAPQP GPAHLSLTITLLMTARLWGGTLLWT (SEQ ID NO:567) of HSUPARAA_P8 (SEQ ID NO:229).

The localization of the variant protein was determined according to results from a number of different software programs and analyses, including analyses from SignalP and other specialized programs. The variant protein is believed to be located as follows with regard to the cell: membrane.

Variant protein HSUPARAA_P8 (SEQ ID NO:229) also has the following non-silent SNPs (Single Nucleotide Polymorphisms) as listed in Table 227, (given according to their position(s) on the amino acid sequence, with the alternative amino acid(s) listed; the last column indicates whether the SNP is known or not; the presence of known SNPs in variant protein HSUPARAA_P8 (SEQ ID NO:229) sequence provides support for the deduced sequence of this variant protein according to the present invention).

TABLE 227

Amino acid mutations

| SNP position(s) on amino acid sequence | Alternative amino acid(s) | Previously known SNP? |
|---|---|---|
| 17 | V -> | No |
| 55 | E -> G | Yes |
| 78 | S -> N | No |
| 86 | T -> A | Yes |
| 100 | Q -> | No |
| 105 | R -> Q | Yes |
| 168 | Y -> * | No |
| 168 | Y -> | No |
| 181 | N -> D | No |
| 190 | C -> R | No |
| 192 | T -> S | No |
| 209 | N -> S | No |
| 217 | K -> R | Yes |
| 239 | N -> S | No |
| 251 | K -> * | No |
| 278 | N -> K | Yes |
| 294 | D -> A | Yes |
| 303 | A -> | No |
| 303 | A -> S | No |
| 314 | L -> P | Yes |
| 317 | T -> I | No |
| 332 | T -> S | No |

The glycosylation sites of variant protein HSUPARAA_P8 (SEQ ID NO:229), as compared to the known protein Urokinase plasminogen activator surface receptor precursor (SEQ ID NO:266), are described in Table 228 (given according to their position(s) on the amino acid sequence in the first column; the second column indicates whether the glycosylation site is present in the variant protein; and the last column indicates whether the position is different on the variant protein).

TABLE 228

Glycosylation site(s)

| Position(s) on known amino acid sequence | Present in variant protein? | Position(s) on variant protein |
|---|---|---|
| 74 | Yes | 74 |
| 181 | Yes | 181 |
| 191 | Yes | 191 |
| 219 | Yes | 219 |
| 252 | Yes | 252 |

The variant protein has the following domains, as determined by using InterPro. The domains are described in Table 229:

TABLE 229

InterPro domain(s)

| Domain description | Analysis type | Position(s) on protein |
|---|---|---|
| Urokinase plasminogen activator surface receptor | BlastProDom | 14-108 |
| CD59 antigen | HMMPfam | 23-100, 212-292 |
| CD59 antigen | HMMSmart | 23-110, 115-204, 211-298 |
| CD59 antigen | ScanRegExp | 24-67, 116-166, 212-266 |

Variant protein HSUPARAA_P8 (SEQ ID NO:229) is encoded by the following transcript(s): HSUPARAA_T11 (SEQ ID NO:182), for which the sequence(s) is/are given at the end of the application. The coding portion of transcript HSUPARAA_T11 (SEQ ID NO:182) is shown in bold; this coding portion starts at position 428 and ends at position 1423. The transcript also has the following SNPs as listed in Table 230 (given according to their position on the nucleotide sequence, with the alternative nucleic acid listed; the last column indicates whether the SNP is known or not; the presence of known SNPs in variant protein HSUPARAA_P8 (SEQ ID NO:229) sequence provides support for the deduced sequence of this variant protein according to the present invention).

TABLE 230

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 649 | C -> T | Yes |
| 660 | G -> A | No |
| 683 | A -> G | Yes |
| 727 | G -> | No |
| 741 | G -> A | Yes |
| 892 | G -> A | No |
| 931 | C -> A | No |

TABLE 230-continued

Nucleic acid SNPs

| SNP position(s) on nucleotide sequence | Alternative nucleic acid(s) | Previously known SNP? |
|---|---|---|
| 931 | C -> | No |
| 968 | A -> G | No |
| 995 | T -> C | No |
| 1002 | C -> G | No |
| 1053 | A -> G | No |
| 1077 | A -> G | Yes |
| 1077 | -> G | No |
| 1143 | A -> G | No |
| 1151 | C -> T | No |
| 1162 | C -> T | Yes |
| 1171 | C -> T | Yes |
| 1178 | A -> T | No |
| 1213 | C -> T | Yes |
| 1261 | C -> A | Yes |
| 1308 | A -> C | Yes |
| 1334 | G -> | No |
| 1334 | G -> T | No |
| 1351 | C -> G | No |
| 1368 | T -> C | Yes |
| 1377 | C -> T | No |
| 1414 | C -> A | Yes |
| 1421 | A -> T | No |
| 1465 | G -> A | Yes |
| 1467 | C -> A | No |
| 1467 | C -> | No |
| 1484 | C -> T | Yes |
| 1532 | G -> A | Yes |
| 1539 | C -> T | No |
| 1588 | G -> C | Yes |
| 1617 | G -> | No |

Variant protein HSUPARAA_P11 (SEQ ID NO:230) according to the present invention has an amino acid sequence as given at the end of the application; it is encoded by transcript(s) HSUPARAA_T14 (SEQ ID NO:183), HSUPARAA_T15 (SEQ ID NO:184), HSUPARAA_T16 (SEQ ID NO:185) and HSUPARAA_T17 (SEQ ID NO:186). An alignment is given to the known protein (Urokinase plasminogen activator surface receptor precursor (SEQ ID NO:216)) at the end of the application. One or more alignments to one or more previously published protein sequences are given at the end of the application. A brief description of the relationship of the variant protein according to the present invention to each such aligned protein is as follows:

1. Comparison Report Between HSUPARAA_P1 I (SEQ ID NO:230) and UPAR_HUMAN (SEQ ID NO:593):

A. An isolated chimeric polypeptide encoding for HSUPARAA_PL11 (SEQ ID NO:230), comprising a first amino acid sequence being at least 90% homologous to MGHPPLLPLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEG-PILELENLPQNGRQCYSCKGNSTHGCSSEETFLIDCRG P MNQCLVATGTHE corresponding to amino acids 1-252 of UPAR_HUMAN (SEQ ID NO:593), which also corresponds to amino acids 1-252 of HSUPARAA_P11 (SEQ ID NO:230), and a second amino acid sequence being at least 70%, optionally at least 80%, preferably at least 85%, more preferably at least 90% and most preferably at least 95% homologous to a polypeptide having the sequence RSLWGSWLPCKSTTALRPPCCEEAQATHV (SEQ ID NO:573) corresponding to amino acids 253-281 of HSUPARAA_P11 (SEQ ID NO:230), wherein said first amino acid sequence and second amino acid sequence are contiguous and in a sequential order.

B. An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence RSLWGSWLPCKSTTALRPPCCEE-AQATHV (SEQ ID NO:573) of HSUPARAA_P11 (SEQ ID NO:230).

2. Comparison Report Between HSUPARAA_P1 I (SEQ ID NO:230) and Q9UPI5_HUMAN (SEQ ID NO:218):

A. An isolated chimeric polypeptide encoding for HSUPARAA_P11 (SEQ ID NO:230), comprising a first amino acid sequence being at least 90% homologous to MGHPPLLPLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEG-PILELENLPQNGRQCYSCKGNSTHGCSSEETFLIDCRG P MNQCLVATGTH corresponding to amino acids 1-251 of Q9UPI5_HUMAN (SEQ ID NO:218), which also corresponds to amino acids 1-251 of HSUPARAA-PI 1 (SEQ ID NO:230), and a second amino acid sequence being at least 70%, optionally at least 80%, preferably at least 85%, more preferably at least 90% and most preferably at least 95% homologous to a polypeptide having the sequence ERSLWGSWLPCKSTTALRPPCCEEAQATHV (SEQ ID NO:574) corresponding to amino acids 252-281 of HSUPARAA_P1 I (SEQ ID NO:230), wherein said first amino acid sequence and second amino acid sequence are contiguous and in a sequential order.

B. An isolated polypeptide encoding for a tail of HSUPARAA_P11 (SEQ ID NO:230), comprising a polypeptide being at least 70%, optionally at least about 80%, preferably at least about 85%, more preferably at least about 90% and most preferably at least about 95% homologous to the sequence ERSLWGSWLPCKSTTALRPPCCEEAQATHV (SEQ ID NO:574) of HSUPARAA-P 11 (SEQ ID NO:230).

3. Comparison Report Between HSUPARAA_P11 (SEQ ID NO:230) and Q9BWT0_HUMAN (SEQ ID NO:223):

A. An isolated chimeric polypeptide encoding for HSUPARAA_P11 (SEQ ID NO:230), comprising a first amino acid sequence being at least 90% homologous to MGHPPLLPLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDR corresponding to amino acids 1-164 of Q9BWT0_HUMAN (SEQ ID NO:223), which also corresponds to amino acids 1-164 of HSUPARAA_P1 I (SEQ ID NO:230), a bridging amino acid H corresponding to amino acid 165 of HSUPARAA_P11 (SEQ ID NO:230), a second amino acid sequence being at least 90% homologous to LRGCGYLPGCPGSNGF-HNNDTFHFLKCCNTTKCNEGPILELEN-LPQNGRQCYSCKGNSTH GCSSEETFLIDCRGPMNQ-CLVATGTHE corresponding to amino acids 166-252 of Q9BWT0_HUMAN (SEQ ID NO:223), which also corresponds to amino acids 166-252 of HSUPARAA_P11 (SEQ ID NO:230), and a third amino acid sequence being at least 70%, optionally at least 80%, preferably at least 85%, more preferably at least 90% and most preferably at least 95% homologous to a polypeptide having the sequence RSLWG-SWLPCKSTTALRPPCCEEAQATHV (SEQ ID NO:573) corresponding to amino acids 253-281 of HSUPAR-A_PL1 (SEQ ID NO:230), wherein said first amino acid sequence, bridging amino acid, second amino acid sequence and third amino acid sequence are contiguous and in a sequential order.

B. An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence RSLWGSWLPCKSTTALRPPCCEE-AQATHV (SEQ ID NO:573) of HSUPARAA-PI I (SEQ ID NO:230).

4. Comparison Report Between HSUPARAAAPL I (SEQ ID NO:230) and NP_002650 (SEQ ID NO:217):

A. An isolated chimeric polypeptide encoding for HSU-PARAA_P11 (SEQ ID NO:230), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEG-PILELENLPQNGRQCYSCKGNSTHGCS SEETFLIDCRGP MNQCLVATGTHE corresponding to amino acids 1-252 of NP_002650 (SEQ ID NO:217), which also corresponds to amino acids 1-252 of HSUPARAA_P11 (SEQ ID NO:230), and a second amino acid sequence being at least 70%, optionally at least 80%, preferably at least 85%, more preferably at least 90% and most preferably at least 95% homologous to a polypeptide having the sequence RSLWG-SWLPCKSTTALRPPCCEEAQATHV (SEQ ID NO:573) corresponding to amino acids 253-281 of HSUPARAA_P11 (SEQ ID NO:230), wherein said first amino acid sequence and second amino acid sequence are contiguous and in a sequential order.

B. An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence RSLWGSWLPCKSTTALRPPCCEE-AQATHV (SEQ ID NO:573) of HSUPARAA_P11 (SEQ ID NO:230).

5. Comparison Report Between HSUPARAA_P11 (SEQ ID NO:230) and Q03405-3 (SEQ ID NO:220):

A. An isolated chimeric polypeptide encoding for HSU-PARAA_P11 (SEQ ID NO:230), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEE corresponding to amino acids 1-157 of Q03405-3 (SEQ ID NO:220), which also corresponds to amino acids 1-157 of HSUPARAA_P11 (SEQ ID NO:230), a second amino acid sequence being at least 70%, optionally at least 80%, preferably at least 85%, more preferably at least 90% and most preferably at least 95% homologous to a polypeptide having the sequence GRPKDDRHL-RGCGYLPGCPGSNGFHNNDTFHFLKCCNTTKCNEGP (SEQ ID NO:564) corresponding to amino acids 158-202 of HSUPARAA_P11 (SEQ ID NO:230), a third amino acid sequence being at least 90% homologous to ILELENLPQN-GRQCYSCKGNSTHGCSSEETFLIDCRGP-MNQCLVATGTHE corresponding to amino acids 158-207 of Q03405-3 (SEQ ID NO:220), which also corresponds to amino acids 203-252 of HSUPARAA_P11 (SEQ ID NO:230), and a fourth amino acid sequence being at least 70%, optionally at least 80%, preferably at least 85%, more preferably at least 90% and most preferably at least 95% homologous to a polypeptide having the sequence RSLWG-SWLPCKSTTALRPPCCEEAQATHV (SEQ ID NO:573) corresponding to amino acids 253-281 of HSUPARAA_P11 (SEQ ID NO:230), wherein said first amino acid sequence, second amino acid sequence, third amino acid sequence and fourth amino acid sequence are contiguous and in a sequential order.

B. An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGP (SEQ ID NO:564) of HSUPARAA_P11 (SEQ ID NO:230).

C. An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence RSLWGSWLPCKSTTALRPPCCEE-AQATHV (SEQ ID NO:573) of HSUPARAA_P11 (SEQ ID NO:230).

6. Comparison Report Between HSUPARAA_P11 (SEQ ID NO:230) and NP_001005377 (SEQ ID NO:221):

A. An isolated chimeric polypeptide encoding for HSU-PARAA_P11 (SEQ ID NO:230), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEE corresponding to amino acids 1-157 of NP_001005377 (SEQ ID NO:221), which also corresponds to amino acids 1-157 of HSUPARAA_P11 (SEQ ID NO:230), a second amino acid sequence being at least 70%, optionally at least 80%, preferably at least 85%, more preferably at least 90% and most preferably at least 95% homologous to a polypeptide having the sequence GRPKD-DRHLRGCGYLPGCPGSNGFHNNDTFH-FLKCCNTTKCNEGPI (SEQ ID NO:565) corresponding to amino acids 158-203 of HSUPARAA_P11 (SEQ ID NO:230), a third amino acid sequence being at least 90% homologous to LELENLPQNGRQCYSCKGNSTHGCS-SEETFLIDCRGPMNQCLVATGTHE corresponding to amino acids 159-207 of NP_001005377 (SEQ ID NO:221), which also corresponds to amino acids 204-252 of HSU-PARAA_P11 (SEQ ID NO:230), and a fourth amino acid sequence being at least 70%, optionally at least 80%, preferably at least 85%, more preferably at least 90% and most preferably at least 95% homologous to a polypeptide having the sequence RSLWGSWLPCKSTTALRPPCCEE-AQATHV (SEQ ID NO:573) corresponding to amino acids 253-281 of HSUPARAA_P11 (SEQ ID NO:230), wherein said first amino acid sequence, second amino acid sequence, third amino acid sequence and fourth amino acid sequence are contiguous and in a sequential order.

B. An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGPI (SEQ ID NO:565) of HSUPARAA_P11 (SEQ ID NO:230).

C. A bridge portion of HSUPARAA_P11 (SEQ ID NO:230), comprising a polypeptide having a length "n", wherein n is at least about 10 amino acids in length, optionally at least about 20 amino acids in length, preferably at least about 30 amino acids in length, more preferably at about 40 amino acids in length and most preferably at least about 50 amino acids in length, wherein at least two amino acids comprise EG, having a structure as follows (numbering according to HSUPARAA_P11): a sequence starting from any of amino acid numbers 157-x to 157; and ending at any of amino acid numbers 158 +((n-2) -x), in which x varies from 0 to n−2.

A bridge portion of HSUPARAA_P11 (SEQ ID NO:230), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IL, having a structure as follows (numbering according to HSUPARAAP111): a sequence starting from any of amino acid numbers 203-x to 203; and ending at any of amino acid numbers 204+((n−2)−x), in which x varies from 0 to n−2.

D. An isolated polypeptide encoding for an edge portion of HSUPARAA_P11 (SEQ ID NO:230), comprising an amino acid sequence being at least 70%, optionally at least about 80%, preferably at least about 85%, more preferably at least about 90% and most preferably at least about 95% homologous to the sequence RSLWGSWLPCKSTTALRPPCCEE-AQATHV (SEQ ID NO:573) of HSUPARAA_P11 (SEQ ID NO:230).

The localization of the variant protein was determined according to results from a number of different software programs and analyses, including analyses from SignalP and other specialized programs. The variant protein is believed to be located as follows with regard to the cell: secreted.

Variant protein HSUPARAA_P11 (SEQ ID NO:230) also has the following non-silent SNPs (Single Nucleotide Polymorphisms) as listed in Table 231, (given according to their position(s) on the amino acid sequence, with the alternative amino acid(s) listed; the last column indicates whether the SNP is known or not; the presence of known SNPs in variant protein HSUPARAA_P11 (SEQ ID NO:230) sequence provides support for the deduced sequence of this variant protein according to the present invention).

TABLE 231

Amino acid mutations

| SNP position(s) on amino acid sequence | Alternative amino acid(s) | Previously known SNP? |
|---|---|---|
| 17 | V -> | No |
| 55 | E -> G | Yes |
| 78 | S -> N | No |
| 86 | T -> A | Yes |
| 100 | Q -> | No |
| 105 | R -> Q | Yes |
| 171 | Y -> * | No |
| 171 | Y -> | No |
| 184 | N -> D | No |
| 193 | C -> R | No |
| 195 | T -> S | No |

TABLE 231-continued

Amino acid mutations

| SNP position(s) on amino acid sequence | Alternative amino acid(s) | Previously known SNP? |
|---|---|---|
| 212 | N -> S | No |
| 220 | K -> R | Yes |
| 242 | N -> S | No |

The glycosylation sites of variant protein HSUPARAA_P11 (SEQ ID NO:230), as compared to the known protein Urokinase plasminogen activator surface receptor precursor (SEQ ID NO:216), are described in Table 232 (given according to their position(s) on the amino acid sequence in the first column; the second column indicates whether the glycosylation site is present in the variant protein; and the last column indicates whether the position is different on the variant protein).

TABLE 232

Glycosylation site(s)

| Position(s) on known amino acid sequence | Present in variant protein? | Position(s) on variant protein |
|---|---|---|
| 74 | Yes | 74 |
| 184 | Yes | 184 |
| 194 | Yes | 194 |
| 222 | Yes | 222 |
| 255 | No | |

The variant protein has the following domains, as determined by using InterPro. The domains are described in Table 233:

TABLE 233

InterPro domain(s)

| Domain description | Analysis type | Position(s) on protein |
|---|---|---|
| Urokinase plasminogen activator surface receptor | BlastProDom | 14-108 |
| CD59 antigen | HMMPfam | 23-100, 215-276 |
| CD59 antigen | HMMSmart | 23-110, 115-207, 214-278 |
| CD59 antigen | ScanRegExp | 24-67, 116-169, 215-262 |

Variant protein HSUPARAA_P11 (SEQ ID NO:230) is encoded by the following transcript(s): HSUPARAA_T14 (SEQ ID NO:183), HSUPARAA_T15 (SEQ ID NO:184), HSUPARAA_T16 (SEQ ID NO:185) and HSUPARAA_T17 (SEQ ID NO:186), for which the sequence(s) is/are given at the end of the application.

The coding portion of transcript HSUPARAA_T14 (SEQ ID NO:183) is shown in bold; this coding portion starts at position 428 and ends at position 1270. The transcript also has the following SNPs as listed in Table 234 (given according to their position on the nucleotide sequence, with the alternative nucleic acid listed; the last column indicates whether the SNP is known or not; the presence of known SNPs in variant protein HSUPARAA_P11 (SEQ ID NO:230) sequence provides support for the deduced sequence of this variant protein according to present invention).

TABLE 234

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 649 | C -> T | Yes |
| 660 | G -> A | No |
| 683 | A -> G | Yes |
| 727 | G -> | No |
| 741 | G -> A | Yes |
| 901 | G -> A | No |
| 940 | C -> A | No |
| 940 | C -> | No |
| 977 | A -> G | No |
| 1004 | T -> C | No |
| 1011 | C -> G | No |
| 1062 | A -> G | No |
| 1086 | A -> G | Yes |
| 1086 | -> G | No |
| 1152 | A -> G | No |
| 1160 | C -> T | No |
| 1171 | C -> T | Yes |
| 1180 | C -> T | Yes |

The coding portion of transcript HSUPARAA_T15 (SEQ ID NO:184) is shown in bold; this coding portion starts at position 428 and ends at position 1270. The transcript also has the following SNPs as listed in Table 235 (given according to their position on the nucleotide sequence, with the alternative nucleic acid listed; the last column indicates whether the SNP is known or not; the presence of known SNPs in variant protein HSUPARAA_P11 (SEQ ID NO:230) sequence provides support for the deduced sequence of this variant protein according to present invention).

TABLE 235

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 649 | C -> T | Yes |
| 660 | G -> A | No |
| 683 | A -> G | Yes |
| 727 | G -> | No |
| 741 | G -> A | Yes |
| 901 | G -> A | No |
| 940 | C -> A | No |
| 940 | C -> | No |
| 977 | A -> G | No |
| 1004 | T -> C | No |
| 1011 | C -> G | No |
| 1062 | A -> G | No |
| 1086 | A -> G | Yes |
| 1086 | -> G | No |
| 1152 | A -> G | No |
| 1160 | C -> T | No |
| 1171 | C -> T | Yes |
| 1180 | C -> T | Yes |

The coding portion of transcript HSUPARAA_T16 (SEQ ID NO:185) is shown in bold; this coding portion starts at position 428 and ends at position 1270. The transcript also has the following SNPs as listed in Table 236 (given according to their position on the nucleotide sequence, with the alternative nucleic acid listed; the last column indicates whether the SNP is known or not; the presence of known SNPs in variant protein HSUPARAA_P11 (SEQ ID NO: 230) sequence provides support for the deduced sequence of this variant protein according to present invention).

TABLE 236

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 649 | C -> T | Yes |
| 660 | G -> A | No |
| 683 | A -> G | Yes |
| 727 | G -> | No |
| 741 | G -> A | Yes |
| 901 | G -> A | No |
| 940 | C -> A | No |
| 940 | C -> | No |
| 977 | A -> G | No |
| 1004 | T -> C | No |
| 1011 | C -> G | No |
| 1062 | A -> G | No |
| 1086 | A -> G | Yes |
| 1086 | -> G | No |
| 1152 | A -> G | No |
| 1160 | C -> T | No |
| 1171 | C -> T | Yes |
| 1180 | C -> T | Yes |
| 1870 | A -> T | Yes |
| 1982 | G -> A | Yes |

The coding portion of transcript HSUPARAA_T17 (SEQ ID NO:186) is shown in bold; this coding portion starts at position 428 and ends at position 1270. The transcript also has the following SNPs as listed in Table 237 (given according to their position on the nucleotide sequence, with the alternative nucleic acid listed; the last column indicates whether the SNP is known or not; the presence of known SNPs in variant protein HSUPARAA_P11 (SEQ ID NO:230) sequence provides support for the deduced sequence of this variant protein according to the present invention).

TABLE 237

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 649 | C -> T | Yes |
| 660 | G -> A | No |
| 683 | A -> G | Yes |
| 727 | G -> | No |
| 741 | G -> A | Yes |
| 901 | G -> A | No |
| 940 | C -> A | No |
| 940 | C -> | No |
| 977 | A -> G | No |
| 1004 | T -> C | No |
| 1011 | C -> G | No |
| 1062 | A -> G | No |
| 1086 | A -> G | Yes |
| 1086 | -> G | No |
| 1152 | A -> G | No |
| 1160 | C -> T | No |
| 1171 | C -> T | Yes |
| 1180 | C -> T | Yes |
| 1734 | A -> T | Yes |
| 1846 | G -> A | Yes |

Variant protein HSUPARAAPIP13 (SEQ ID NO:231) according to the present invention has an amino acid sequence as given at the end of the application; it is encoded by transcript(s) HSUPARAA_T19 (SEQ ID NO:187). An alignment is given to the known protein (Urokinase plasminogen activator surface receptor precursor (SEQ ID NO:216)) at the end of the application. One or more alignments to one or more previously published protein sequences are given at the end of the application. A brief description of the relationship of the variant protein according to the present invention to each such aligned protein is as follows:

1. Comparison Report Between HSUPARAA_P13 (SEQ ID NO:231) and UPAR_HUMAN (SEQ ID NO:593)_V1 (SEQ ID NO:225):

A. An isolated chimeric polypeptide encoding for HSU-PARAA_P13 (SEQ ID NO:231), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEG-PILELENLPQNGRQCYSCKGNSTHGCSSEETFLIDCR-GP MNQCLVATGTH corresponding to amino acids 1-251 of UPAR_HUMAN (SEQ ID NO:593)_V1 (SEQ ID NO:225), which also corresponds to amino acids 1-251 of HSU-PARAA_P13 (SEQ ID NO:231), and a second amino acid sequence being at least 70%, optionally at least 80%, preferably at least 85%, more preferably at least 90% and most preferably at least 95% homologous to a polypeptide having the sequence GCGHFCHGKVEFRLGAVAEACTLSTLGG (SEQ ID NO:577) corresponding to amino acids 252-279 of HSUPARAA_P13 (SEQ ID NO:231), wherein said first amino acid sequence and second amino acid sequence are contiguous and in a sequential order.

B. An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTL-STLGG (SEQ ID NO:577) of HSUPARAA_P13 (SEQ ID NO:231).

It should be noted that the known protein sequence (UPAR_HUMAN (SEQ ID NO:593)) has one or more changes than the sequence given at the end of the application and named as being the amino acid sequence for UPAR_HUMAN (SEQ ID NO:593)_V1 (SEQ ID NO:225). These changes were previously known to occur and are listed in the table below.

TABLE 238

Changes to UPAR_HUMAN (SEQ ID NO: 593)_V1 (SEQ ID NO: 225)

| SNP position on amino acid sequence | Type of change |
|---|---|
| 252 | conflict |

2. Comparison Report Between HSUPARAA_P13 (SEQ ID NO:231) and Q9UP15_HUMAN (SEQ ID NO:218):

A. An isolated chimeric polypeptide encoding for HSU-PARAA_P13 (SEQ ID NO:231), comprising a first amino acid sequence being at least 90% homologous to MGHPPLL-PLLLLLHTCVPASWGLRCMQCKTNGD-CRVEECALGQDLCRTTIRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEG-PILELENLPQNGRQCYSCKGNSTHGCSSEETFLIDCR-GP MNQCLVATGTH corresponding to amino acids 1-251 of Q9UPI5_HUMAN (SEQ ID NO:218), which also corresponds to amino acids 1-251 of HSUPARAA_P13 (SEQ ID NO:231), and a second amino acid sequence being at least 70%, optionally at least 80%, preferably at least 85%, more preferably at least 90% and most preferably at least 95% homologous to a polypeptide having the sequence GCGH-FCHGKVEFRLGAVAEACTLSTLGG (SEQ ID NO:577) corresponding to amino acids 252-279 of HSUPARAA_P13 (SEQ ID NO:231), wherein said first amino acid sequence and second amino acid sequence are contiguous and in a sequential order.

B. An isolated polypeptide encoding for a tail of HSU-PARAA_P13 (SEQ ID NO:231), comprising a polypeptide being at least 70%, optionally at least about 80%, preferably at least about 85%, more preferably at least about 90% and most preferably at least about 95% homologous to the sequence GCGHFCHGKVEFRLGAVAEACTLSTLGG (SEQ ID NO:577) of HSUPARAA_P13 (SEQ ID NO:231).

3. Comparison Report Between HSUPARAA-PI3 (SEQ ID NO:231) and Q03405-2 (SEQ ID NO:219):

A. An isolated chimeric polypeptide encoding for HSU-PARAA_P13 (SEQ ID NO:231), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE- EQCLDVVTHWIQEGEEGRPKDDRHLRGCGYLPGCPGSN GFHNNDTFHFLKCCNTTKCNEGPILELENLPQNGRQCYSCKGNSTHGCS SEETFLIDCRGP MNQCLVATGTH corresponding to amino acids 1-251 of Q03405-2 (SEQ ID NO:219), which also corresponds to amino acids 1-251 of HSUPARAA_P13 (SEQ ID NO:231), and a second amino acid sequence being at least 70%, optionally at least 80%, preferably at least 85%, more preferably at least 90% and most preferably at least 95% homologous to a polypeptide having the sequence GCGHFCHGKVEFRLGAVAEACTLSTLGG (SEQ ID NO:577) corresponding to amino acids 252-279 of HSUPARAA_P13 (SEQ ID NO:231), wherein said first amino acid sequence and second amino acid sequence are contiguous and in a sequential order.

B. An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTLSTLGG (SEQ ID NO:577) of HSUPARAA_P13 (SEQ ID NO:231).

4. Comparison Report Between HSUPARAA_P13 (SEQ ID NO:231) and NP_001005376 (SEQ ID NO:222):

A. An isolated chimeric polypeptide encoding for HSUPARAA_P13 (SEQ ID NO:231), comprising a first amino acid sequence being at least 90% homologous to MGHPPLLPLLLLLHTCVPASWGLRCMQCKTNGDCRVEECALGQDLCRTTIVRLWEEGEE LELVEKSCTHSEKTNRTLSYRTGLKITSLTEVVCGLDLCNQGNSGRAVTYSRSRYLECISC GSSDMSCERGRHQSLQCRSPEEQCLDVVTHWIQEGEEGRPKDDRHLRGCGYLPGCPGSN GFHNNDTFHFLKCCNTTKCNEGPILELENLPQNGRQCYSCKGNSTHGCSSEETFLIDCRGP MNQCLVATGTH corresponding to amino acids 1-251 of NP_001005376 (SEQ ID NO:222), which also corresponds to amino acids 1-251 of HSUPARAA_P13 (SEQ ID NO:231), and a second amino acid sequence being at least 70%, optionally at least 80%, preferably at least 85%, more preferably at least 90% and most preferably at least 95% homologous to a polypeptide having the sequence GCGHFCHGKVEFRLGAVAEACTLSTLGG (SEQ ID NO:577) corresponding to amino acids 252-279 of HSUPARAA_P13 (SEQ ID NO:231), wherein said first amino acid sequence and second amino acid sequence are contiguous and in a sequential order.

B. An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTLSTLGG (SEQ ID NO:577) of HSUPARAA_P13 (SEQ ID NO:231).

5. Comparison Report Between HSUPARAA_P13 (SEQ ID NO:231) and Q9BWT0_HUMAN (SEQ ID NO:223):

A. An isolated chimeric polypeptide encoding for HSUPARAA_P13 (SEQ ID NO:231), comprising a first amino acid sequence being at least 90% homologous to MGHPPLLPLLLLLHTCVPASWGLRCMQCKTNGDCRVEECALGQDLCRTTIVRLWEEGEE LELVEKSCTHSEKTNRTLSYRTGLKITSLTEVVCGLDLCNQGNSGRAVTYSRSRYLECISC GSSDMSCERGRHQSLQCRSPEEQCLDVVTHWIQEGEEGRPKDDR corresponding to amino acids 1-164 of Q9BWT0_HUMAN (SEQ ID NO:223), which also corresponds to amino acids 1-164 of HSUPARAA_P13 (SEQ ID NO:231), a bridging amino acid H corresponding to amino acid 165 of HSUPARAA_P13 (SEQ ID NO:231), a second amino acid sequence being at least 90% homologous to LRGCGYLPGCPGSNGFHNNDTFHFLKCCNTTKCNEGPILELENLPQNGRQCYSCKGNSTH GCSSEETFLIDCRGPMNQCLVATGTH corresponding to amino acids 166-251 of Q9BWT0_HUMAN (SEQ ID NO:223), which also corresponds to amino acids 166-251 of HSUPARAA_P13 (SEQ ID NO:231), and a third amino acid sequence being at least 70%, optionally at least 80%, preferably at least 85%, more preferably at least 90% and most preferably at least 95% homologous to a polypeptide having the sequence GCGHFCHGKVEFRLGAVAEACTLSTLGG (SEQ ID NO:577) corresponding to amino acids 252-279 of HSUPARAA_P13 (SEQ ID NO:231), wherein said first amino acid sequence, bridging amino acid, second amino acid sequence and third amino acid sequence are contiguous and in a sequential order.

B. An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTLSTLGG (SEQ ID NO:577) of HSUPARAA_P13 (SEQ ID NO:231).

6. Comparison Report Between HSUPARAA_P13 (SEQ ID NO:231) and NP_002650_V1 (SEQ ID NO:224):

A. An isolated chimeric polypeptide encoding for HSUPARAA_P13 (SEQ ID NO:231), comprising a first amino acid sequence being at least 90% homologous to MGHPPLLPLLLLLHTCVPASWGLRCMQCKTNGDCRVEECALGQDLCRTTIVRLWEEGEE LELVEKSCTHSEKTNRTLSYRTGLKITSLTEVVCGLDLCNQGNSGRAVTYSRSRYLECISC GSSDMSCERGRHQSLQCRSPEEQCLDVVTHWIQEGEEGRPKDDRHLRGCGYLPGCPGSN GFHNNDTFHFLKCCNTTKCNEGPILELENLPQNGRQCYSCKGNSTHGCSSEETFLIDCRGP MNQCLVATGTH corresponding to amino acids 1-251 of NP_002650_V1 (SEQ ID NO:224), which also corresponds to amino acids 1-251 of HSUPARAA_P13 (SEQ ID NO:231), and a second amino acid sequence being at least 70%, optionally at least 80%, preferably at least 85%, more preferably at least 90% and most preferably at least 95% homologous to a polypeptide having the sequence GCGHFCHGKVEFRLGAVAEACTLSTLGG (SEQ ID NO:577) corresponding to amino acids 252-279 of HSUPARAA_P13 (SEQ ID NO:231), wherein said first amino acid sequence and second amino acid sequence are contiguous and in a sequential order.

B. An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTLSTLGG (SEQ ID NO:577) of HSUPARAA_P13 (SEQ ID NO:231).

It should be noted that the known protein sequence (NP_002650) has one or more changes than the sequence given at the end of the application and named as being the amino acid sequence for NP_002650_V1 (SEQ ID NO:224). These changes were previously known to occur and are listed in the table below.

TABLE 239

Changes to NP_002650_V1

| SNP position on amino acid sequence | Type of change |
|---|---|
| 252 | conflict |

7. Comparison Report Between HSUPARAA_P13 (SEQ ID NO:231) and Q03405-3 (SEQ ID NO:220):

A. An isolated chimeric polypeptide encoding for HSUPARAA_P13 (SEQ ID NO:231), comprising a first amino acid sequence being at least 90% homologous to MGHPPLLPLLLLLHTCVPASWGLRCMQCKTNGD-CRVEECALGQDLCRTTIVRLWEEGEE LELVEKSCTHSEKTNRTLSYRTGLKITSLTEVVCGLDLCNQGNSGRA VTYSRSRYLECISC GSSDMSCERGRHQSLQCRSPE-EQCLDVVTHWIQEGEE corresponding to amino acids 1-157 of Q03405-3 (SEQ ID NO:220), which also corresponds to amino acids 1-157 of HSUPARAA_P13 (SEQ ID NO:231), a second amino acid sequence being at least 70%, optionally at least 80%, preferably at least 85%, more preferably at least 90% and most preferably at least 95% homologous to a polypeptide having the sequence GRPKDDRHLRGCGYLPGCPGSNGFHNNDTFHFLKCCNTTKCNEGP (SEQ ID NO:564) corresponding to amino acids 158-202 of HSUPARAA_P13 (SEQ ID NO:231), a third amino acid sequence being at least 90% homologous to ILELENLPQN-GRQCYSCKGNSTHGCSSEETFLIDCRGP-MNQCLVATGTH corresponding to amino acids 158-206 of Q03405-3 (SEQ ID NO:220), which also corresponds to amino acids 203-251 of HSUPARAA_P13 (SEQ ID NO:231), and a fourth amino acid sequence being at least 70%, optionally at least 80%, preferably at least 85%, more preferably at least 90% and most preferably at least 95% homologous to a polypeptide having the sequence GCGHFCHGKVEFRLGAVAEACTLSTLGG (SEQ ID NO:577) corresponding to amino acids 252-279 of HSUPARAA_P 13 (SEQ ID NO:231), wherein said first amino acid sequence, second amino acid sequence, third amino acid sequence and fourth amino acid sequence are contiguous and in a sequential order.

B. An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGP (SEQ ID NO:564) of HSUPARAA_P13 (SEQ ID NO:231).

C. An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTL-STLGG (SEQ ID NO:577) of HSUPARAA_P13 (SEQ ID NO:231).

8. Comparison Report Between HSUPARAA_P13 (SEQ ID NO:231) and NP_001005377 (SEQ ID NO:221):

A. An isolated chimeric polypeptide encoding for HSUPARAA_P13 (SEQ ID NO:231), comprising a first amino acid sequence being at least 90% homologous to MGHPPLLPLLLLLHTCVPASWGLRCMQCKTNGD-CRVEECALGQDLCRTTIVRLWEEGEE LELVEKSCTHSEKTNRTLSYRTGLKITSLTEVVCGLDLCNQGNSGRA VTYSRSRYLECISC GSSDMSCERGRHQSLQCRSPE-EQCLDVVTHWIQEGEE corresponding to amino acids 1-157 of NP_001005377 (SEQ ID NO:221), which also corresponds to amino acids 1-157 of HSUPARAA_P13 (SEQ ID NO:231), a second amino acid sequence being at least 70%, optionally at least 80%, preferably at least 85%, more preferably at least 90% and most preferably at least 95% homologous to a polypeptide having the sequence GRPKDDRHLRGCGYLPGCPGSNGFHNNDTFH-FLKCCNTTKCNEGPI (SEQ ID NO:565) corresponding to amino acids 158-203 of HSUPARAA_P13 (SEQ ID NO:231), a third amino acid sequence being at least 90% homologous to LELENLPQNGRQCYSCKGNSTHGCS-SEETFLIDCRGPMNQCLVATGTH corresponding to amino acids 159-206 of NP_001005377 (SEQ ID NO:221), which also corresponds to amino acids 204-251 of HSUPARAA_P13 (SEQ ID NO:231), and a fourth amino acid sequence being at least 70%, optionally at least 80%, preferably at least 85%, more preferably at least 90% and most preferably at least 95% homologous to a polypeptide having the sequence GCGHFCHGKVEFRLGAVAEACTLSTLGG (SEQ ID NO:577) corresponding to amino acids 252-279 of HSUPARAA_P13 (SEQ ID NO:231), wherein said first amino acid sequence, second amino acid sequence, third amino acid sequence and fourth amino acid sequence are contiguous and in a sequential order.

B. An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGPI (SEQ ID NO:565) of HSUPARAA_P13 (SEQ ID NO:231).

C. A bridge portion of HSUPARAA_P13 (SEQ ID NO:231), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows (numbering according to HSUPARAA_P13): a sequence starting from any of amino acid numbers 157-x to 157; and ending at any of amino acid numbers 158+((n−2)−x), in which x varies from 0 to n−2.

A bridge portion of HSUPARAA_P13 (SEQ ID NO:231), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IL, having a structure as follows (numbering according to HSUPARAA_P13): a sequence starting from any of amino acid numbers 203-x to 203; and ending at any of amino acid numbers 204+((n−2)−x), in which x varies from 0 to n−2.

D. An isolated polypeptide encoding for an edge portion of HSUPARAA_P13 (SEQ ID NO:231), comprising an amino acid sequence being at least 70%, optionally at least about 80%, preferably at least about 85%, more preferably at least about 90% and most preferably at least about 95% homologous to the sequence GCGHFCHGKVEFRLGAVAEACTL-STLGG (SEQ ID NO:577) of HSUPARAA_P13 (SEQ ID NO:231).

The localization of the variant protein was determined according to results from a number of different software programs and analyses, including analyses from SignalP and other specialized programs. The variant protein is believed to be located as follows with regard to the cell: secreted.

Variant protein HSUPARAA_P13 (SEQ ID NO:231) also has the following non-silent SNPs (Single Nucleotide Polymorphisms) as listed in Table 240, (given according to their position(s) on the amino acid sequence, with the alternative amino acid(s) listed; the last column indicates whether the SNP is known or not; the presence of known SNPs in variant protein HSUPARAA_P13 (SEQ ID NO:231) sequence provides support for the deduced sequence of this variant protein according to the present invention).

TABLE 240

Amino acid mutations

| SNP position(s) on amino acid sequence | Alternative amino acid(s) | Previously known SNP? |
|---|---|---|
| 17 | V -> | No |
| 55 | E -> G | Yes |
| 78 | S -> N | No |
| 86 | T -> A | Yes |
| 100 | Q -> | No |
| 105 | R -> Q | Yes |
| 171 | Y -> * | No |
| 171 | Y -> | No |
| 184 | N -> D | No |
| 193 | C -> R | No |
| 195 | T -> S | No |
| 212 | N -> S | No |
| 220 | K -> R | Yes |
| 242 | N -> S | No |
| 267 | A -> V | Yes |

The glycosylation sites of variant protein HSUPARAA_P13 (SEQ ID NO:231), as compared to the known protein Urokinase plasminogen activator surface receptor precursor (SEQ ID NO:216), are described in Table 241 (given according to their position(s) on the amino acid sequence in the first column; the second column indicates whether the glycosylation site is present in the variant protein; and the last column indicates whether the position is different on the variant protein).

TABLE 241

Glycosylation site(s)

| Position(s) on known amino acid sequence | Present in variant protein? | Position(s) on variant protein |
|---|---|---|
| 74 | Yes | 74 |
| 184 | Yes | 184 |
| 194 | Yes | 194 |
| 222 | Yes | 222 |
| 255 | No | |

The variant protein has the following domains, as determined by using InterPro. The domains are described in Table 242:

TABLE 242

InterPro domain(s)

| Domain description | Analysis type | Position(s) on protein |
|---|---|---|
| Urokinase plasminogen activator surface receptor | BlastProDom | 14-108 |
| CD59 antigen | HMMPfam | 23-100, 215-271 |
| CD59 antigen | HMMSmart | 23-110, 115-207, 214-277 |
| CD59 antigen | ScanRegExp | 24-67, 116-169, 215-257 |

Variant protein HSUPARAA_P13 (SEQ ID NO:231) is encoded by the following transcript(s): HSUPARAA_T19 (SEQ ID NO:187), for which the sequence(s) is/are given at the end of the application. The coding portion of transcript HSUPARAA_T19 (SEQ ID NO:187) is shown in bold; this coding portion starts at position 428 and ends at position 1264. The transcript also has the following SNPs as listed in Table 243 (given according to their position on the nucleotide sequence, with the alternative nucleic acid listed; the last column indicates whether the SNP is known or not; the presence of known SNPs in variant protein HSUPARAA_P13 (SEQ ID NO:231) sequence provides support for the deduced sequence of this variant protein according to the present invention).

TABLE 243

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 649 | C -> T | Yes |
| 660 | G -> A | No |
| 683 | A -> G | Yes |
| 727 | G -> | No |
| 741 | G -> A | Yes |
| 901 | G -> A | No |
| 940 | C -> A | No |
| 940 | C -> | No |
| 977 | A -> G | No |
| 1004 | T -> C | No |
| 1011 | C -> G | No |
| 1062 | A -> G | No |
| 1086 | A -> G | Yes |
| 1086 | -> G | No |
| 1152 | A -> G | No |
| 1160 | C -> T | No |
| 1171 | C -> T | Yes |
| 1180 | C -> T | Yes |
| 1227 | C -> T | Yes |
| 1269 | G -> A | Yes |
| 1318 | A -> G | Yes |
| 1519 | C -> T | Yes |

Variant protein HSUPARAA_P14 (SEQ ID NO:232) according to the present invention has an amino acid sequence as given at the end of the application; it is encoded by transcript(s) HSUPARAA_T20 (SEQ ID NO:188). An alignment is given to the known protein (Urokinase plasminogen activator surface receptor precursor (SEQ ID NO:216)) at the end of the application. One or more alignments to one or more previously published protein sequences are given at the end of the application. A brief description of the relationship of the variant protein according to the present invention to each such aligned protein is as follows:

1. Comparison Report Between HSUPARAA_P14 (SEQ ID NO:232) and UPAR_HUMAN (SEQ ID NO:593):

A. An isolated chimeric polypeptide encoding for HSUPARAA_P14 (SEQ ID NO:232), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH- SEKTNRTLSYRTGLKITSLTEVVCGLDLCNQGNSGRA VTYSRSRYLECISC GSSDMSCERGRHQSLQCRSPEEQCLDVVTHWIQEGEEGRPKDDRHL-RGCGYLPGCPGSN GFHNNDTFHFLKCCNTTKCNEGP corresponding to amino acids 1-202 of UPAR_HUMAN SEQ ID NO:593), which also corresponds to amino acids 1-202 of HSUPARAA_P14 (SEQ ID NO:232), a second bridging amino acid sequence comprising of K, and a third amino acid sequence being at least 90% homologous to PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) corresponding to amino acids 253-335 of UPAR_HUMAN (SEQ ID NO:593), which also corresponds to amino acids 204-286 of HSUPARAA_P14 (SEQ ID NO:232), wherein said first amino acid sequence, second amino acid sequence and third amino acid sequence are contiguous and in a sequential order.

B. An isolated polypeptide encoding for an edge portion of HSUPARAA_P14 (SEQ ID NO:232), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PK having a structure as follows (numbering according to HSUPARAA_P14): a sequence starting from any of amino acid numbers 202-x to 202; and ending at any of amino acid numbers 203+((n−2)−x), in which x varies from 0 to n−2.

An isolated polypeptide encoding for an edge portion of HSUPARAA_P14 (SEQ ID NO:232), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KP having a structure as follows (numbering according to HSUPARAA_P14): a sequence starting from any of amino acid numbers 203-x to 203; and ending at any of amino acid numbers 204+((n−2)−x), in which x varies from 0 to n−2.

2. Comparison Report Between HSUPARAA_P14 (SEQ ID NO:232) and NP_002650 (SEQ ID NO:217):

A. An isolated chimeric polypeptide encoding for HSUPARAA_P14 (SEQ ID NO:232), comprising a first amino acid sequence being at least 90% homologous to MGHPPLLPLLLLLHTCVPASWGLRCMQCKTNGDCRVEECALGQDLCRTTIVRLWEEGEE LELVEKSCTHSEKTNRTLSYRTGLKITSLTEVVCGLDLCNQGNSGRA VTYSRSRYLECISC GSSDMSCERGRHQSLQCRSPEEQCLDVVTHWIQEGEEGRPKDDRHL-RGCGYLPGCPGSN GFHNNDTFHFLKCCNTTKCNEGP corresponding to amino acids 1-202 of NP_002650 (SEQ ID NO:217), which also corresponds to amino acids 1-202 of HSUPARAA_P14 (SEQ ID NO:232), a second bridging amino acid sequence comprising of K, and a third amino acid sequence being at least 90% homologous to PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) corresponding to amino acids 253-335 of NP_002650 (SEQ ID NO:217), which also corresponds to amino acids 204-286 of HSUPARAA_P14 (SEQ ID NO:232), wherein said first amino acid sequence, second amino acid sequence and third amino acid sequence are contiguous and in a sequential order.

B. An isolated polypeptide encoding for an edge portion of HSUPARAA_P14 (SEQ ID NO:232), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PK having a structure as follows (numbering according to HSUPARAA_P14): a sequence starting from any of amino acid numbers 202-x to 202; and ending at any of amino acid numbers 203+((n−2)−x), in which x varies from 0 to n−2.

An isolated polypeptide encoding for an edge portion of HSUPARAA_P14 (SEQ ID NO:232), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KP having a structure as follows (numbering according to HSUPARAA_P14): a sequence starting from any of amino acid numbers 203-x to 203; and ending at any of amino acid numbers 204+((n−2)−x), in which x varies from 0 to n−2.

3. Comparison Report Between HSUPARAA_P14 (SEQ ID NO:232) and Q9BWT0_HUMAN (SEQ ID NO:223):

A. An isolated chimeric polypeptide encoding for HSUPARAA_P14 (SEQ ID NO:232), comprising a first amino acid sequence being at least 90% homologous to MGHPPLLPLLLLLHTCVPASWGLRCMQCKTNGDCRVEECALGQDLCRTTIVRLWEEGEE LELVEKSCTHSEKTNRTLSYRTGLKITSLTEVVCGLDLCNQGNSGRA VTYSRSRYLECISC GSSDMSCERGRHQSLQCRSPEEQCLDVVTHWIQEGEEGRPKDDR corresponding to amino acids 1-164 of Q9BWT0_HUMAN (SEQ ID NO:223), which also corresponds to amino acids 1-164 of HSUPARAA_P14 (SEQ ID NO:232), a bridging amino acid H corresponding to amino acid 165 of HSUPARAA_P14 (SEQ ID NO:232), a second amino acid sequence being at least 90% homologous to LRGCGYLPGCPGSNGF-HNNDTFHFLKCCNTTKCNEGP corresponding to amino acids 166-202 of Q9BWT0_HUMAN (SEQ ID NO:223), which also corresponds to amino acids 166-202 of HSUPARAA_P14 (SEQ ID NO:232), a third bridging amino acid sequence comprising of K, a fourth amino acid sequence being at least 90% homologous to PKNQSYMVRGCATASMCQHAHLGDAFSMNHIDVSC-CTKSGCNHPDLDVQ (SEQ ID NO:589) corresponding to amino acids 253-301 of Q9BWT0_HUMAN (SEQ ID NO:223), which also corresponds to amino acids 204-252 of HSUPARAA_P14 (SEQ ID NO:232), and a fifth amino acid sequence being at least 70%, optionally at least 80%, preferably at least 85%, more preferably at least 90% and most preferably at least 95% homologous to a polypeptide having the sequence YRSGAAPQPGPAHLSLTITLLMTARLWGGTLLWT (SEQ ID NO:563) corresponding to amino acids 253-286 of HSUPARAA_P14 (SEQ ID NO:232), wherein said first amino acid sequence, bridging amino acid, second amino acid sequence, third amino acid sequence, fourth amino acid sequence and fifth amino acid sequence are contiguous and in a sequential order.

B. An isolated polypeptide encoding for an edge portion of HSUPARAA_P14 (SEQ ID NO:232), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PK having a structure as follows (numbering according to HSUPARAA_P14): a sequence starting from any of amino acid numbers 202-x to 202; and ending at any of amino acid numbers 203+((n−2)−x), in which x varies from 0 to n−2.

An isolated polypeptide encoding for an edge portion of HSUPARAA_P14 (SEQ ID NO:232), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KP having a structure as follows (numbering according to HSUPARAA_P14): a sequence starting from any of amino acid numbers 203-x to 203; and ending at any of amino acid numbers 204+((n−2)−x), in which x varies from 0 to n−2.

C. An isolated polypeptide encoding for a tail of HSUPARAA_P14 (SEQ ID NO:232), comprising a polypeptide being at least 70%, optionally at least about 80%, preferably at least about 85%, more preferably at least about 90% and most preferably at least about 95% homologous to the sequence YRSGAAPQPGPAHLSLTITLLMTARLWGGTLLWT (SEQ ID NO:563) of HSUPARAA_P14 (SEQ ID NO:232).

4. Comparison Report Between HSUPARAA_P14 (SEQ ID NO:232) and Q03405-3 (SEQ ID NO:220):

A. An isolated chimeric polypeptide encoding for HSUPARAA_P14 (SEQ ID NO:232), comprising a first amino acid sequence being at least 90% homologous to MGHPPLLPLLLLLHTCVPASWGLRCMQCKTNGDCRVEECALGQDLCRTTIVRLWEEGEE LELVEKSCTHSEKTNRTLSYRTGLKITSLTEVVCGLDLCNQGNSGRAVTYSRSRYLECISC GSSDMSCERGRHQSLQCRSPEEQCLDVVTHWIQEGEE corresponding to amino acids 1-157 of Q03405-3 (SEQ ID NO:220), which also corresponds to amino acids 1-157 of HSUPARAA_P14 (SEQ ID NO:232), a second amino acid sequence being at least 70%, optionally at least 80%, preferably at least 85%, more preferably at least 90% and most preferably at least 95%, homologous to a polypeptide having the sequence GRPKDDRHLRGCGYLPGCPGSNGFHNNDTFHFLKCCNTTKCNEGPK (SEQ ID NO:604) corresponding to amino acids 158-203 of HSUPARAA_P14 (SEQ ID NO:232), and a third amino acid sequence being at least 90% homologous to PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) corresponding to amino acids 208-290 of Q03405-3 (SEQ ID NO:220), which also corresponds to amino acids 204-286 of HSUPARAA_P14 (SEQ ID NO:232), wherein said first amino acid sequence, second amino acid sequence and third amino acid sequence are contiguous and in a sequential order.

5. Comparison Report Between HSUPARAA_P14 (SEQ ID NO:232) and NP_001005377 (SEQ ID NO:221):

A. An isolated chimeric polypeptide encoding for HSUPARAA_P14 (SEQ ID NO:232), comprising a first amino acid sequence being at least 90% homologous to MGHPPLLPLLLLLHTCVPASWGLRCMQCKTNGDCRVEECALGQDLCRTTIVRLWEEGEE LELVEKSCTHSEKTNRTLSYRTGLKITSLTEVVCGLDLCNQGNSGRAVTYSRSRYLECISC GSSDMSCERGRHQSLQCRSPEEQCLDVVTHWIQEGEE corresponding to amino acids 1-157 of NP_001005377 (SEQ ID NO:221), which also corresponds to amino acids 1-157 of HSUPARAA_P14 (SEQ ID NO:232), a second amino acid sequence being at least 70%, optionally at least 80%, preferably at least 85%, more preferably at least 90% and most preferably at least 95%, homologous to a polypeptide having the sequence GRPKDDRHLRGCGYLPGCPGSNGFHNNDTFHFLKCCNTTKCNEGPK (SEQ ID NO:604) corresponding to amino acids 158-203 of HSUPARAA_P14 (SEQ ID NO:232), and a third amino acid sequence being at least 90% homologous to PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) corresponding to amino acids 208-290 of NP_001005377 (SEQ ID NO:221), which also corresponds to amino acids 204-286 of HSUPARAA_P14 (SEQ ID NO:232), wherein said first amino acid sequence, second amino acid sequence and third amino acid sequence are contiguous and in a sequential order.

6. Comparison Report Between HSUPARAA_P14 (SEQ ID NO:232) and Q9UPI5_HUMAN (SEQ ID NO:218):

A. An isolated chimeric polypeptide encoding for HSUPARAA_P14 (SEQ ID NO:232), comprising a first amino acid sequence being at least 90% homologous to MGHPPLLPLLLLLHTCVPASWGLRCMQCKTNGDCRVEECALGQDLCRTTIVRLWEEGEE LELVEKSCTHSEKTNRTLSYRTGLKITSLTEVVCGLDLCNQGNSGRAVTYSRSRYLECISC GSSDMSCERGRHQSLQCRSPEEQCLDVVTHWIQEGEEGRPKDDRHLRGCGYLPGCPGSN GFHNNDTFHFLKCCNTTKCNEGP corresponding to amino acids 1-202 of Q9UPI5_HUMAN (SEQ ID NO:218), which also corresponds to amino acids 1-202 of HSUPARAA_P14 (SEQ ID NO:232), and a second amino acid sequence being at least 70%, optionally at least 80%, preferably at least 85%, more preferably at least 90% and most preferably at least 95% homologous to a polypeptide having the sequence KPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:582) corresponding to amino acids 203-286 of HSUPARAA_P14 (SEQ ID NO:232), wherein said first amino acid sequence and second amino acid sequence are contiguous and in a sequential order.

B. An isolated polypeptide encoding for an edge portion of HSUPARAA_P14 (SEQ ID NO:232), comprising an amino acid sequence being at least 70%, optionally at least about 80%, preferably at least about 85%, more preferably at least about 90% and most preferably at least about 95% homologous to the sequence KPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:582) of HSUPARAA_P14 (SEQ ID NO:232).

7. Comparison Report Between HSUPARAA_P14 (SEQ ID NO:232) and NP_001005376 (SEQ ID NO:222):

A. An isolated chimeric polypeptide encoding for HSUPARAA_P14 (SEQ ID NO:232), comprising a first amino acid sequence being at least 90% homologous to MGHPPLLPLLLLLHTCVPASWGLRCMQCKTNGDCRVEECALGQDLCRTTIVRLWEEGEE LELVEKSCTHSEKTNRTLSYRTGLKITSLTEVVCGLDLCNQGNSGRAVTYSRSRYLECISC GSSDMSCERGRHQSLQCRSPEEQCLDVVTHWIQEGEEGRPKDDRHLRGCGYLPGCPGSN GFHNNDTFHFLKCCNTTKCNEGP corresponding to amino acids 1-202 of NP_001005376 (SEQ ID NO:222), which also corresponds to amino acids 1-202 of HSUPARAA_P14 (SEQ ID NO:232), and a second amino acid sequence being at least 70%, optionally at least 80%, preferably at least 85%, more preferably at least 90% and most preferably at least 95% homologous to a polypeptide having the sequence KPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:582) corresponding to amino acids 203-286 of HSUPARAA_P14 (SEQ ID NO:232), wherein said first amino acid sequence and second amino acid sequence are contiguous and in a sequential order.

B. An isolated polypeptide encoding for an edge portion of HSUPARAA_P14 (SEQ ID NO:232), comprising an amino acid sequence being at least 70%, optionally at least about 80%, preferably at least about 85%, more preferably at least about 90% and most preferably at least about 95% homologous to the sequence KPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:582) of HSUPARAA_P14 (SEQ ID NO:232).

8. Comparison Report Between HSUPARAA_P14 (SEQ ID NO:232) and Q03405-2 (SEQ ID NO:219):

A. An isolated chimeric polypeptide encoding for HSUPARAA_P14 (SEQ ID NO:232), comprising a first amino acid sequence being at least 90% homologous to MGHPPLLPLLLLHTCVPASWGLRCMQCKTNGDCRVEECALGQDLCRTTIVRLWEEGEE LELVEKSCTHSEKTNRTLSYRTGLKITSLTEVVCGLDLCNQGNSGRA VTYSRSRYLECISC GSSDMSCERGRHQSLQCRSPEEQCLDVVTHWIQEGEEGRPKDDRHLRGCGYLPGCPGSN GFHNNDTFHFLKCCNTTKCNEGP corresponding to amino acids 1-202 of Q03405-2 (SEQ ID NO:219), which also corresponds to amino acids 1-202 of HSUPARAA_P14 (SEQ ID NO:232), and a second amino acid sequence being at least 70%, optionally at least 80%, preferably at least 85%, more preferably at least 90% and most preferably at least 95% homologous to a polypeptide having the sequence KPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:582)corresponding to amino acids 203-286 of HSUPARAA_P14 (SEQ ID NO:232), wherein said first amino acid sequence and second amino acid sequence are contiguous and in a sequential order.

B. An isolated polypeptide encoding for an edge portion of HSUPARAA_P14 (SEQ ID NO:232), comprising an amino acid sequence being at least 70%, optionally at least about 80%, preferably at least about 85%, more preferably at least about 90% and most preferably at least about 95% homologous to the sequence KPKNQSYMVRGCATASMCQHAHLGDAFSMNHIDVSCCTKSGCNHPDLDVQYRSGAAPQ PGPAHLSLTITLLMTARLWGGTLLWT (SEQ ID NO:582) of HSUPARAA_P14 (SEQ ID NO:232).

The localization of the variant protein was determined according to results from a number of different software programs and analyses, including analyses from SignalP and other specialized programs. The variant protein is believed to be located as follows with regard to the cell: membrane.

Variant protein HSUPARAA_P14 (SEQ ID NO:232) also has the following non-silent SNPs (Single Nucleotide Polymorphisms) as listed in Table 244, (given according to their position(s) on the amino acid sequence, with the alternative amino acid(s) listed; the last column indicates whether the SNP is known or not; the presence of known SNPs in variant protein HSUPARAA_P14 (SEQ ID NO:232) sequence provides support for the deduced sequence of this variant protein according to the present invention).

TABLE 244

Amino acid mutations

| SNP position(s) on amino acid sequence | Alternative amino acid(s) | Previously known SNP? |
|---|---|---|
| 17 | V -> | No |
| 55 | E -> G | Yes |
| 78 | S -> N | No |
| 86 | T -> A | Yes |
| 100 | Q -> | No |
| 105 | R -> Q | Yes |
| 171 | Y -> * | No |
| 171 | Y -> | No |
| 184 | N -> D | No |
| 193 | C -> R | No |
| 195 | T -> S | No |
| 205 | K -> * | No |
| 232 | N -> K | Yes |
| 248 | D -> A | Yes |
| 257 | A -> | No |
| 257 | A -> S | No |
| 268 | L -> P | Yes |
| 271 | T -> I | No |
| 286 | T -> S | No |

The glycosylation sites of variant protein HSUPARAA_P14 (SEQ ID NO:232), as compared to the known protein Urokinase plasminogen activator surface receptor precursor (SEQ ID NO:216), are described in Table 245 (given according to their position(s) on the amino acid sequence in the first column; the second column indicates whether the glycosylation site is present in the variant protein; and the last column indicates whether the position is different on the variant protein).

TABLE 245

Glycosylation site(s)

| Position(s) on known amino acid sequence | Present in variant protein? | Position(s) on variant protein |
|---|---|---|
| 74 | Yes | 74 |
| 184 | Yes | 184 |
| 194 | Yes | 194 |
| 206 | Yes | 206 |
| 222 | No | |

The variant protein has the following domains, as determined by using InterPro. The domains are described in Table 246:

TABLE 246

InterPro domain(s)

| Domain description | Analysis type | Position(s) on protein |
|---|---|---|
| Urokinase plasminogen activator surface receptor | BlastProDom | 14-108 |
| CD59 antigen | HMMPfam | 23-100, 175-246 |
| CD59 antigen | HMMSmart | 23-110, 115-207 |
| CD59 antigen | ScanRegExp | 24-67, 116-169 |

Variant protein HSUPARAA_P14 (SEQ ID NO:232) is encoded by the following transcript(s): HSUPARAA_T20

(SEQ ID NO:188), for which the sequence(s) is/are given at the end of the application. The coding portion of transcript HSUPARAA_T20 (SEQ ID NO:188) is shown in bold; this coding portion starts at position 428 and ends at position 1285. The transcript also has the following SNPs as listed in Table 247 (given according to their position on the nucleotide sequence, with the alternative nucleic acid listed; the last column indicates whether the SNP is known or not; the presence of known SNPs in variant protein HSUPARAA_P14 (SEQ ID NO:232) sequence provides support for the deduced sequence of this variant protein according to the present invention).

TABLE 247

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 649 | C -> T | Yes |
| 660 | G -> A | No |
| 683 | A -> G | Yes |
| 727 | G -> | No |
| 741 | G -> A | Yes |
| 901 | G -> A | No |
| 940 | C -> A | No |
| 940 | C -> | No |
| 977 | A -> G | No |
| 1004 | T -> C | No |
| 1011 | C -> G | No |
| 1040 | A -> T | No |
| 1075 | C -> T | Yes |
| 1123 | C -> A | Yes |
| 1170 | A -> C | Yes |
| 1196 | G -> | No |
| 1196 | G -> T | No |
| 1213 | C -> G | No |
| 1230 | T -> C | Yes |
| 1239 | C -> T | No |
| 1276 | C -> A | Yes |
| 1283 | A -> T | No |
| 1327 | G -> A | Yes |
| 1329 | C -> A | No |
| 1329 | C -> | No |
| 1346 | C -> T | Yes |
| 1394 | G -> A | Yes |
| 1401 | C -> T | No |
| 1450 | G -> C | Yes |
| 1479 | G -> | No |

Variant protein HSUPARAA_P15 (SEQ ID NO:233) according to the present invention has an amino acid sequence as given at the end of the application; it is encoded by transcript(s) HSUPARAA_T21 (SEQ ID NO:189). An alignment is given to the known protein (Urokinase plasminogen activator surface receptor precursor (SEQ ID NO:216)) at the end of the application. One or more alignments to one or more previously published protein sequences are given at the end of the application. A brief description of the relationship of the variant protein according to the present invention to each such aligned protein is as follows:

1. Comparison Report Between HSUPARAA_P15 (SEQ ID NO:233) and UPAR_HUMAN (SEQ ID NO:593):

A. An isolated chimeric polypeptide encoding for HSUPARAA_P15 (SEQ ID NO:233), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEGP corresponding to amino acids 1-202 of UPAR_HUMAN (SEQ ID NO:593), which also corresponds to amino acids 1-202 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence SKERETQNRKTKAIW (SEQ ID NO:583) corresponding to amino acids 203-217 of HSUPARAA_P15 (SEQ ID NO:233), wherein said first amino acid sequence and second amino acid sequence are contiguous and in a sequential order.

B. An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence SKERETQNRKTKAIW (SEQ ID NO:583) of HSUPARAA_P15 (SEQ ID NO:233).

2. Comparison Report Between HSUPARAA_P15 (SEQ ID NO:233) and Q9UPI5_HUMAN (SEQ ID NO:218):

A. An isolated chimeric polypeptide encoding for HSUPARAA_P15 (SEQ ID NO:233), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEGP corresponding to amino acids 1-202 of Q9UP15_HUMAN (SEQ ID NO:218), which also corresponds to amino acids 1-202 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence SKERETQNRKTKAIW (SEQ ID NO:583) corresponding to amino acids 203-217 of HSUPARAA_P15 (SEQ ID NO:233), wherein said first amino acid sequence and second amino acid sequence are contiguous and in a sequential order.

B. An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence SKERETQNRKTKAIW (SEQ ID NO:583) of HSUPARAA_P15 (SEQ ID NO:233).

3. Comparison Report Between HSUPARAA_P15 (SEQ ID NO:233) and Q03405-2 (SEQ ID NO:219):

A. An isolated chimeric polypeptide encoding for HSUPARAA_P15 (SEQ ID NO:233), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEGP corresponding to amino acids 1-202 of Q03405-2 (SEQ ID NO:219), which also corresponds to amino acids 1-202 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence SKERETQNRKTKAIW (SEQ ID NO:583) corresponding to amino acids 203-217 of HSU-PARAA_P15 (SEQ ID NO:233), wherein said first amino acid sequence and second amino acid sequence are contiguous and in a sequential order.

B. An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence SKERETQNRKTKAIW (SEQ ID NO:583) of HSUPARAA_P15 (SEQ ID NO:233).

4. Comparison Report Between HSUPARAA_P15 (SEQ ID NO:233) and NP_001005376 (SEQ ID NO:222):

A. An isolated chimeric polypeptide encoding for HSU-PARAA_P15 (SEQ ID NO:233), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEGP corresponding to amino acids 1-202 of NP_001005376 (SEQ ID NO:222), which also corresponds to amino acids 1-202 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence SKERETQNRKTKAIW (SEQ ID NO:583) corresponding to amino acids 203-217 of HSU-PARAA_P15 (SEQ ID NO:233), wherein said first amino acid sequence and second amino acid sequence are contiguous and in a sequential order.

B. An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence SKERETQNRKTKAIW (SEQ ID NO:583) of HSUPARAA_P15 (SEQ ID NO:233).

5. Comparison Report Between HSUPARAA_P15 (SEQ ID NO:233) and Q9BWT0_HUMAN (SEQ ID NO:223):

A. An isolated chimeric polypeptide encoding for HSU-PARAA_P15 (SEQ ID NO:233), comprising a first amino acid sequence being at least 90% homologous to MGHPPLL-PLLLLLHTCVPASWGLRCMQCKTNGD-CRVEECALGQDLCRTTIRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDR corresponding to amino acids 1-164 of Q9BWT0_HUMAN (SEQ ID NO:223), which also corresponds to amino acids 1-164 of HSUPARAA_P15 (SEQ ID NO:233), a bridging amino acid H corresponding to amino acid 165 of HSUPARAA_P15 (SEQ ID NO:233), a second amino acid sequence being at least 90% homologous to LRGCGYLPGCPGSNGF-HNNDTFHFLKCCNTTKCNEGP corresponding to amino acids 166-202 of Q9BWT0_HUMAN (SEQ ID NO:223), which also corresponds to amino acids 166-202 of HSU-PARAA_P15 (SEQ ID NO:233), and a third amino acid sequence being at least 70%, optionally at least 80%, preferably at least 85%, more preferably at least 90% and most preferably at least 95% homologous to a polypeptide having the sequence SKERETQNRKTKAIW (SEQ ID NO:583) corresponding to amino acids 203-217 of HSUPARAA_P15 (SEQ ID NO:233), wherein said first amino acid sequence, bridging amino acid, second amino acid sequence and third amino acid sequence are contiguous and in a sequential order.

B. An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence SKERETQNRKTKAIW (SEQ ID NO:583) of HSUPARAA_P15 (SEQ ID NO:233).

6. Comparison Report Between HSUPARAA_P15 (SEQ ID NO:233) and NP_002650 (SEQ ID NO:217):

A. An isolated chimeric polypeptide encoding for HSU-PARAA_P15 (SEQ ID NO:233), comprising a first amino acid sequence being at least 90% homologous to MGHPPLL-PLLLLLHTCVPASWGLRCMQCKTNGD-CRVEECALGQDLCRTTIRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEEGRPKDDRHL-RGCGYLPGCPGSN GFHNNDTFHFLKCCNTTKCNEGP corresponding to amino acids 1-202 of NP_002650 (SEQ ID NO:217), which also corresponds to amino acids 1-202 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence SKERETQNRKTKAIW (SEQ ID NO:583) corresponding to amino acids 203-217 of HSU-PARAA_P15 (SEQ ID NO:233), wherein said first amino acid sequence and second amino acid sequence are contiguous and in a sequential order.

B. An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence SKERETQNRKTKAIW (SEQ ID NO:583) of HSUPARAA_P15 (SEQ ID NO:233).

7. Comparison Report Between HSUPARAA_P15 (SEQ ID NO:233) and NP_001005377 (SEQ ID NO:221):

A. An isolated chimeric polypeptide encoding for HSU-PARAA_P15 (SEQ ID NO:233), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEE corresponding to amino acids 1-157 of NP_001005377 (SEQ ID NO:221), which also corresponds to amino acids 1-157 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence GRPKD-DRHLRGCGYLPGCPGSNGFHNNDTFH-FLKCCNTTKCNEGPSKERETQNRKTKAI W (SEQ ID NO:584) corresponding to amino acids 158-217 of HSUPARAA_P15 (SEQ ID NO:233), wherein said first amino acid sequence and second amino acid sequence are contiguous and in a sequential order.

B. An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGPSKERETQNRKTKAI W (SEQ ID NO:584) of HSUPARAA_P15 (SEQ ID NO:233).

8. Comparison Report Between HSUPARAA_P15 (SEQ ID NO:233) and Q03405-3 (SEQ ID NO:220):

A. An isolated chimeric polypeptide encoding for HSUPARAA_P15 (SEQ ID NO:233), comprising a first amino acid sequence being at least 90% homologous to MGHPPLL-PLLLLLHTCVPASWGLRCMQCKTNGD-CRVEECALGQDLCRTTIVRLWEEGEE LELVEKSCTH-SEKTNRTLSYRTGLKITSLTEVVCGLDLCNQGNSGRA VTYSRSRYLECISC GSSDMSCERGRHQSLQCRSPE-EQCLDVVTHWIQEGEE corresponding to amino acids 1-157 of Q03405-3 (SEQ ID NO:220), which also corresponds to amino acids 1-157 of HSUPARAA_P15 (SEQ ID NO:233), and a second amino acid sequence being at least 70%, optionally at least 80%, preferably at least 85%, more preferably at least 90% and most preferably at least 95% homologous to a polypeptide having the sequence GRPKD-DRHLRGCGYLPGCPGSNGFHNNDTFH-FLKCCNTTKCNEGPSKERETQNRKTKAI W (SEQ ID NO:584) corresponding to amino acids 158-217 of HSUPARAA_P15 (SEQ ID NO:233), wherein said first amino acid sequence and second amino acid sequence are contiguous and in a sequential order.

B. An isolated polypeptide encoding for an edge portion of HSUPARAA_P15 (SEQ ID NO:233), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGPSKERETQNRKTKAI W (SEQ ID NO:584) of HSUPARAA_P15 (SEQ ID NO:233).

The localization of the variant protein was determined according to results from a number of different software programs and analyses, including analyses from SignalP and other specialized programs. The variant protein is believed to be located as follows with regard to the cell: secreted.

Variant protein HSUPARAA_P15 (SEQ ID NO:233) also has the following non-silent SNPs (Single Nucleotide Polymorphisms) as listed in Table 248, (given according to their position(s) on the amino acid sequence, with the alternative amino acid(s) listed; the last column indicates whether the SNP is known or not; the presence of known SNPs in variant protein HSUPARAA_P15 (SEQ ID NO:233) sequence provides support for the deduced sequence of this variant protein according to the present invention).

TABLE 248

| SNP position(s) on amino acid sequence | Amino acid mutations Alternative amino acid(s) | Previously known SNP? |
|---|---|---|
| 17 | V -> | No |
| 55 | E -> G | Yes |
| 78 | S -> N | No |
| 86 | T -> A | Yes |
| 100 | Q -> | No |
| 105 | R -> Q | Yes |
| 171 | Y -> * | No |
| 171 | Y -> | No |
| 184 | N -> D | No |
| 193 | C -> R | No |
| 195 | T -> S | No |

The glycosylation sites of variant protein HSUPARAA_P15 (SEQ ID NO:233), as compared to the known protein Urokinase plasminogen activator surface receptor precursor (SEQ ID NO:216), are described in Table 249 (given according to their position(s) on the amino acid sequence in the first column; the second column indicates whether the glycosylation site is present in the variant protein; and the last column indicates whether the position is different on the variant protein).

TABLE 249

| Position(s) on known amino acid sequence | Glycosylation site(s) Present in variant protein? | Position(s) on variant protein |
|---|---|---|
| 74 | Yes | 74 |
| 184 | Yes | 184 |
| 194 | Yes | 194 |
| 222 | No | |
| 255 | No | |

The variant protein has the following domains, as determined by using InterPro. The domains are described in Table 250:

TABLE 250

| Domain description | InterPro domain(s) Analysis type | Position(s) on protein |
|---|---|---|
| Urokinase plasminogen activator surface receptor | BlastProDom | 14-108 |
| CD59 antigen | HMMPfam | 23-100 |
| CD59 antigen | HMMSmart | 23-110, 115-211 |
| CD59 antigen | ScanRegExp | 24-67, 116-169 |

Variant protein HSUPARAA_P15 (SEQ ID NO:233) is encoded by the following transcript(s): HSUPARAA_T21 (SEQ ID NO:189), for which the sequence(s) is/are given at the end of the application. The coding portion of transcript HSUPARAA_T21 (SEQ ID NO:189) is shown in bold; this coding portion starts at position 428 and ends at position 1078. The transcript also has the following SNPs as listed in Table 251 (given according to their position on the nucleotide sequence, with the alternative nucleic acid listed; the last column indicates whether the SNP is known or not; the presence of known SNPs in variant protein HSUPARAA_P15 (SEQ ID NO:233) sequence provides support for the deduced sequence of this variant protein according to the present invention).

TABLE 251

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 649 | C -> T | Yes |
| 660 | G -> A | No |
| 683 | A -> G | Yes |
| 727 | G -> | No |
| 741 | G -> A | Yes |
| 901 | G -> A | No |
| 940 | C -> A | No |
| 940 | C -> | No |
| 977 | A -> G | No |
| 1004 | T -> C | No |
| 1011 | C -> G | No |
| 1060 | A -> T | No |
| 1095 | C -> T | Yes |
| 1143 | C -> A | Yes |
| 1190 | A -> C | Yes |
| 1216 | G -> | No |
| 1216 | G -> T | No |
| 1233 | C -> G | No |
| 1250 | T -> C | Yes |
| 1259 | C -> T | No |
| 1296 | C -> A | Yes |
| 1303 | A -> T | No |
| 1347 | G -> A | Yes |
| 1349 | C -> A | No |
| 1349 | C -> | No |
| 1366 | C -> T | Yes |
| 1414 | G -> A | Yes |
| 1421 | C -> T | No |
| 1470 | G -> C | Yes |
| 1499 | G -> | No |

Variant protein HSUPARAA_P16 (SEQ ID NO:234) according to the present invention has an amino acid sequence as given at the end of the application; it is encoded by transcript(s) HSUPARAA_T22 (SEQ ID NO:190). An alignment is given to the known protein (Urokinase plasminogen activator surface receptor precursor (SEQ ID NO:216)) at the end of the application. One or more alignments to one or more previously published protein sequences are given at the end of the application. A brief description of the relationship of the variant protein according to the present invention to each such aligned protein is as follows:

1. Comparison Report Between HSUPARAA_P16 (SEQ ID NO:234) and UPAR_HUMAN (SEQ ID NO:593):

A. An isolated chimeric polypeptide encoding for HSUPARAA_P16 (SEQ ID NO:234), comprising a first amino acid sequence being at least 90% homologous to MGHPPLLPLLLLLHTCVPASWGLRCMQCKTNGD-CRVEECALGQDLCRTTFVRLWE corresponding to amino acids 1-55 of UPAR_HUMAN (SEQ ID NO:593), which also corresponds to amino acids 1-55 of HSUPARAA_P16 (SEQ ID NO:234), and a second amino acid sequence being at least 90% homologous to GRAVTYSRSRYLECISCGSSDM-SCERGRHQSLQCRSPEEQCLDVVTH-WIQEGEEGRPKDD RHLRGCGYLPGCPGSNGF-HNNDTFHFLKCCNTTKCNEGPILELENLPQNGRQCY SCKGNS THGCSSEETFLIDCRGPMNQCLVATGTH-EPKNQSYMVRGCATASMCQHAHLGDAFSMN HID-VSCCTKSGCNHPDLDVQYRSGAAPQPG-PAHLSLTITLLMTARLWGGTLLWT corresponding to amino acids 104-335 of UPAR_HUMAN (SEQ ID NO:593), which also corresponds to amino acids 56-287 of HSUPARAA_P16 (SEQ ID NO:234), wherein said first amino acid sequence and second amino acid sequence are contiguous and in a sequential order.

B. An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

2. Comparison Report Between HSUPARAA_P16 (SEQ ID NO:234) and NP_002650 (SEQ ID NO:217):

A. An isolated chimeric polypeptide encoding for HSUPARAA_P16 (SEQ ID NO:234), comprising a first amino acid sequence being at least 90% homologous to MGHPPLLPLLLLLHTCVPASWGLRCMQCKTNGD-CRVEECALGQDLCRTTIVRLWE corresponding to amino acids 1-55 of NP_002650 (SEQ ID NO:217), which also corresponds to amino acids 1-55 of HSUPARAA_P16 (SEQ ID NO:234), and a second amino acid sequence being at least 90% homologous to GRAVTYSRSRYLECISCGSSDM-SCERGRHQSLQCRSPEEQCLDVVTH-WIQEGEEGRPKDD RHLRGCGYLPGCPGSNGF-HNNDTFHFLKCCNTTKCNEGPILELENLPQNGRQCY SCKGNS THGCSSEETFLIDCRGPMNQCLVATGTH-EPKNQSYMVRGCATASMCQHAHLGDAFSMN HID-VSCCTKSGCNHPDLDVQYRSGAAPQPG-PAHLSLTITLLMTARLWGGTLLWT corresponding to amino acids 104-335 of NP_002650 (SEQ ID NO:217), which also corresponds to amino acids 56-287 of HSUPARAA_P16 (SEQ ID NO:234), wherein said first amino acid sequence and second amino acid sequence are contiguous and in a sequential order.

B. An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

3. Comparison Report Between HSUPARAA_P16 (SEQ ID NO:234) and Q9BWT0_HUMAN (SEQ ID NO:223):

A. An isolated chimeric polypeptide encoding for HSUPARAA_P16 (SEQ ID NO:234), comprising a first amino acid sequence being at least 90% homologous to MGHPPLLPLLLLLHTCVPASWGLRCMQCKTNGD-CRVEECALGQDLCRTTIRLWE corresponding to amino acids 1-55 of Q9BWT0_HUMAN (SEQ ID NO:223), which also corresponds to amino acids 1-55 of HSUPARAA_P16

(SEQ ID NO:234), a second amino acid sequence being at least 90% homologous to GRAVTYSRSRYLECISCGSS-DMSCERGRHQSLQCRSPEEQCLDVVTH-WIQEGEEGRPKDD R corresponding to amino acids 104-164 of Q9BWT0_HUMAN (SEQ ID NO:223), which also corresponds to amino acids 56-116 of HSUPARAA_P16 (SEQ ID NO:234), a bridging amino acid H corresponding to amino acid 117 of HSUPARAA_P16 (SEQ ID NO:234), a third amino acid sequence being at least 90% homologous to LRGCGYLPGCPGSNGFHNNDTFHFLKC-CNTTKCNEGPILELENLPQNGRQCYSCKGNSTH GCS-SEETFLIDCRGPMNQCLVATGTHEPKN-QSYMVRGCATASMCQHAHLGDAFSMNHID VSCCTKSGCNHPDLDVQ corresponding to amino acids 166-301 of Q9BWT0_HUMAN (SEQ ID NO:223), which also corresponds to amino acids 118-253 of HSU-PARAA_P16 (SEQ ID NO:234), and a fourth amino acid sequence being at least 70%, optionally at least 80%, preferably at least 85%, more preferably at least 90% and most preferably at least 95% homologous to a polypeptide having the sequence YRSGAAPQPGPAHLSLTITLLMTARLWG-GTLLWT (SEQ ID NO:563) corresponding to amino acids 254-287 of HSUPARAA_P16 (SEQ ID NO:234), wherein said first amino acid sequence, second amino acid sequence, bridging amino acid, third amino acid sequence and fourth amino acid sequence are contiguous and in a sequential order.

B. An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

C. An isolated polypeptide encoding for a tail of HSU-PARAA_P16 (SEQ ID NO:234), comprising a polypeptide being at least 70%, optionally at least about 80%, preferably at least about 85%, more preferably at least about 90% and most preferably at least about 95% homologous to the sequence YRSGAAPQPGPAHLSLTITLLMTARLWG-GTLLWT (SEQ ID NO:563) of HSUPARAA_P16 (SEQ ID NO:234).

4. Comparison Report Between HSUPARAA_P16 (SEQ ID NO:234) and Q03405-3 (SEQ ID NO:220):

A. An isolated chimeric polypeptide encoding for HSU-PARAA_P16 (SEQ ID NO:234), comprising a first amino acid sequence being at least 90% homologous to MGHPPLL-PLLLLLHTCVPASWGLRCMQCKTNGD-CRVEECALGQDLCRTTIVRLWE corresponding to amino acids 1-55 of Q03405-3 (SEQ ID NO:220), which also corresponds to amino acids 1-55 of HSUPARAA_P16 (SEQ ID NO:234), a second amino acid sequence being at least 90% homologous to GRAVTYSRSRYLECISCGSSDMSCER-GRHQSLQCRSPEEQCLDVVTHWIQEGEE corresponding to amino acids 104-157 of Q03405-3 (SEQ ID NO:220), which also corresponds to amino acids 56-109 of HSU-PARAA_P16 (SEQ ID NO:234), a third amino acid sequence being at least 70%, optionally at least 80%, preferably at least 85%, more preferably at least 90% and most preferably at least 95% homologous to a polypeptide having the sequence GRPKDDRHLRGCGYLPGCPGSNGF-HNNDTFHFLKCCNTTKCNEGP (SEQ ID NO:564) corresponding to amino acids 110-154 of HSUPARAA_P16 (SEQ ID NO:234), and a fourth amino acid sequence being at least 90% homologous to ILELENLPQNGRQCYSCKGNSTH-GCSSEETFLIDCRGPMNQCLVATGTHEP-KNQSYMVRG CATASMCQHAHLGDAFSMNHIDVSC-CTKSGCNHPDLDVQYRSGAAPQPGPAHLSLTITLL MTARLWGGTLLWT corresponding to amino acids 158-290 of Q03405-3 (SEQ ID NO:220), which also corresponds to amino acids 155-287 of HSUPARAA_P16 (SEQ ID NO:234), wherein said first amino acid sequence, second amino acid sequence, third amino acid sequence and fourth amino acid sequence are contiguous and in a sequential order.

B. An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

C. An isolated polypeptide encoding for an edge portion of HSUPARAA_P16 (SEQ ID NO:234), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGP (SEQ ID NO:564) of HSUPARAA_P16 (SEQ ID NO:234).

5. Comparison Report Between HSUPARAA_P16 (SEQ ID NO:234) and NP_001005377 (SEQ ID NO:221):

A. An isolated chimeric polypeptide encoding for HSU-PARAA_P16 (SEQ ID NO:234), comprising a first amino acid sequence being at least 90% homologous to MGHPPLL-PLLLLLHTCVPASWGLRCMQCKTNGD-CRVEECALGQDLCRTTIVRLWE corresponding to amino acids 1-55 of NP_001005377 (SEQ ID NO:221), which also corresponds to amino acids 1-55 of HSUPARAA_P16 (SEQ ID NO:234), a second amino acid sequence being at least 90% homologous to GRAVTYSRSRYLECISCGSSDM-SCERGRHQSLQCRSPEEQCLDVVTHWIQEGEE corresponding to amino acids 104-157 of NP_001005377 (SEQ ID NO:221), which also corresponds to amino acids 56-109 of HSUPARAA_P16 (SEQ ID NO:234), a third amino acid sequence being at least 70%, optionally at least 80%, preferably at least 85%, more preferably at least 90% and most preferably at least 95% homologous to a polypeptide having the sequence GRPKDDRHLRGCGYLPGCPGSNGF-HNNDTFHFLKCCNTTKCNEGPI (SEQ ID NO:565) corresponding to amino acids 110-155 of HSUPARAA_P16 (SEQ ID NO:234), and a fourth amino acid sequence being at least 90% homologous to LELENLPQNGRQCYSCKGN-STHGCSSEETFLIDCRGPMNQCLVAT-GTHEPKNQSYMVRG CATASMCQHAHLGDAFSMN-HIDVSCCTKSGCNHPDLDVQYRSGAAPQPGPAHLSLT ITLL MTARLWGGTLLWT corresponding to amino acids 159-290 of NP_001005377 (SEQ ID NO:221), which also corresponds to amino acids 156-287 of HSUPARAA_P16 (SEQ ID NO:234), wherein said first amino acid sequence, second amino acid sequence, third amino acid sequence and fourth amino acid sequence are contiguous and in a sequential order.

B. An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

C. An isolated polypeptide encoding for an edge portion of HSUPARAA_P16 (SEQ ID NO:234), comprising an amino acid sequence being at least 70%, optionally at least about 80%, preferably at least about 85%, more preferably at least about 90% and most preferably at least about 95% homologous to the sequence GRPKDDRHLRGCGYLPGCPGSNG-FHNNDTFHFLKCCNTTKCNEGPI (SEQ ID NO:565) of HSUPARAA_P16 (SEQ ID NO:234).

D. A bridge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EGI, having a structure as follows (numbering according to HSUPARAA_P16): a sequence starting from any of amino acid numbers 157-x to 157; and ending at any of amino acid numbers 110+((n−2)−x), in which x varies from 0 to n−2. A bridge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise IL, having a structure as follows (numbering according to HSUPARAA_P16): a sequence starting from any of amino acid numbers 155-x to 155; and ending at any of amino acid numbers 156+((n−2)−x), in which x varies from 0 to n−2.

6. Comparison report between HSUPARAA_P16 (SEQ ID NO:234) and Q9UPI5_HUMAN (SEQ ID NO:218):

A. An isolated chimeric polypeptide encoding for HSUPARAA_P16 (SEQ ID NO:234), comprising a first amino acid sequence being at least 90% homologous to MGHPPLL-PLLLLLHTCVPASWGLRCMQCKTNGD-CRVEECALGQDLCRTTIVRLWE corresponding to amino acids 1-55 of Q9UPI5_HUMAN (SEQ ID NO:218), which also corresponds to amino acids 1-55 of HSUPARAA_P16 (SEQ ID NO:234), a second amino acid sequence being at least 90% homologous to GRAVTYSRSRYLECISCGSS-DMSCERGRHQSLQCRSPEEQCLDVVTH-WIQEGEEGRPKDD RHLRGCGYLPGCPGSNGF-HNNDTFHFLKCCNTTKCNEGPILELENLPQNGRQCYS CKGNS THGCSSEETFLIDCRGPMNQCLVATGTH corresponding to amino acids 104-251 of Q9UPI5_HUMAN (SEQ ID NO:218), which also corresponds to amino acids 56-203 of HSUPARAA_P16 (SEQ ID NO:234), and a third amino acid sequence being at least 70%, optionally at least 80%, preferably at least 85%, more preferably at least 90% and most preferably at least about 95% homologous to a polypeptide having the sequence EPKNQSYMVRGCATASMC-QHAHLGDAFSMNHIDVSCCTKSGCNHP-DLDVQYRSGAAPQ PGPAHLSLTITLLMTARLWGGTLLWT (SEQ ID NO:566) corresponding to amino acids 204-287 of HSUPARAA_P16 (SEQ ID NO:234), wherein said first amino acid sequence, second amino acid sequence and third amino acid sequence are contiguous and in a sequential order.

B. An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

C. An isolated polypeptide encoding for a tail of HSUPARAA_P16 (SEQ ID NO:234), comprising a polypeptide being at least 70%, optionally at least about 80%, preferably at least about 85%, more preferably at least about 90% and most preferably at least about 95% homologous to the sequence EPKNQSYMVRGCATASMCQHAHLGDAF-SMNHIDVSCCTKSGCNHPDLDVQYRSGAAPQ PGPAHLSLTITLLMTARLWGGTLLWT (SEQ ID NO:566) of HSUPARAA_P16 (SEQ ID NO:234).

7. Comparison Report Between HSUPARAA_P16 (SEQ ID NO:234) and NP_001005376 (SEQ ID NO:222):

A. An isolated chimeric polypeptide encoding for HSUPARAA_P16 (SEQ ID NO:234), comprising a first amino acid sequence being at least 90% homologous to MGHPPLL-PLLLLLHTCVPASWGLRCMQCKTNGD-CRVEECALGQDLCRTTIVRLWE corresponding to amino acids 1-55 of NP_001005376 (SEQ ID NO:222), which also corresponds to amino acids 1-55 of HSUPARAA_P16 (SEQ ID NO:234), a second amino acid sequence being at least 90% homologous to GRAVTYSRSRYLECISCGSSDM-SCERGRHQSLQCRSPEEQCLDVVTH-WIQEGEEGRPKDD RHLRGCGYLPGCPGSNGF-HNNDTFHFLKCCNTTKCNEGPILELENLPQNGRQCYS CKGNS THGCSSEETFLIDCRGPMNQCLVATGTHE corresponding to amino acids 104-252 of NP_001005376 (SEQ ID NO:222), which also corresponds to amino acids 56-204 of HSUPARAA_P16 (SEQ ID NO:234), and a third amino acid sequence being at least 70%, optionally at least 80%, preferably at least 85%, more preferably at least 90% and most preferably at least about 95% homologous to a polypeptide having the sequence PKNQSYMVRGCATASMCQHAHL-GDAFSMNHIDVSCCTKSGCNHPDLDVQYRSGAAPQP GPAHLSLTITLLMTARLWGGTLLWT (SEQ ID NO:567) corresponding to amino acids 205-287 of HSUPARAA_P16 (SEQ ID NO:234), wherein said first amino acid sequence, second amino acid sequence and third amino acid sequence are contiguous and in a sequential order.

B. An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

C. An isolated polypeptide encoding for an edge portion of HSUPARAA_P16 (SEQ ID NO:234), comprising an amino acid sequence being at least 70%, optionally at least about 80%, preferably at least about 85%, more preferably at least about 90% and most preferably at least about 95% homologous to the sequence PKNQSYMVRGCATASMCQHAHL-GDAFSMNHIDVSCCTKSGCNHPDLDVQYRSGAAPQP GPAHLSLTITLLMTARLWGGTLLWT (SEQ ID NO:567) of HSUPARAA_P16 (SEQ ID NO:234).

8. Comparison Report Between HSUPARAA_P16 (SEQ ID NO:234) and Q03405-2 (SEQ ID NO:219):

A. An isolated chimeric polypeptide encoding for HSUPARAA_P16 (SEQ ID NO:234), comprising a first amino acid sequence being at least 90% homologous to MGHPPLLPLLLLLHTCVPASWGLRCMQCKTNGDCRVEECALGQDLCRTTWRLWE corresponding to amino acids 1-55 of Q03405-2 (SEQ ID NO:219), which also corresponds to amino acids 1-55 of HSUPARAA_P16 (SEQ ID NO:234), a second amino acid sequence being at least 90% homologous to GRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHE corresponding to amino acids 104-252 of Q03405-2 (SEQ ID NO:219), which also corresponds to amino acids 56-204 of HSUPARAA_P16 (SEQ ID NO:234), and a third amino acid sequence being at least 70%, optionally at least 80%, preferably at least 85%, more preferably at least 90% and most preferably at least 95% homologous to a polypeptide having the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) corresponding to amino acids 205-287 of HSUPARAA_P16 (SEQ ID NO:234), wherein said first amino acid sequence, second amino acid sequence and third amino acid sequence are contiguous and in a sequential order.

B. An isolated chimeric polypeptide encoding for an edge portion of HSUPARAA_P16 (SEQ ID NO:234), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EG, having a structure as follows: a sequence starting from any of amino acid numbers 55-x to 55; and ending at any of amino acid numbers 56+((n−2)−x), in which x varies from 0 to n−2.

C. An isolated polypeptide encoding for an edge portion of HSUPARAA_P16 (SEQ ID NO:234), comprising an amino acid sequence being at least 70%, optionally at least about 80%, preferably at least about 85%, more preferably at least about 90% and most preferably at least about 95% homologous to the sequence PKNQSYMVRGCATASMCQHAHLGDAFSMNHIDVSCCTKSGCNHPDLDVQYRSGAAPQP GPAHLSLTITLLMTARLWGGTLLWT (SEQ ID NO:567) of HSUPARAA_P16 (SEQ ID NO:234).

The localization of the variant protein was determined according to results from a number of different software programs and analyses, including analyses from SignalP and other specialized programs. The variant protein is believed to be located as follows with regard to the cell: membrane.

Variant protein HSUPARAA_P16 (SEQ ID NO:234) also has the following non-silent SNPs (Single Nucleotide Polymorphisms) as listed in Table 252, (given according to their position(s) on the amino acid sequence, with the alternative amino acid(s) listed; the last column indicates whether the SNP is known or not; the presence of known SNPs in variant protein HSUPARAA_P16 (SEQ ID NO:234) sequence provides support for the deduced sequence of this variant protein according to the present invention).

TABLE 252

| SNP position(s) on amino acid sequence | Alternative amino acid(s) | Previously known SNP? |
|---|---|---|
| 17 | V -> | No |
| 55 | E -> G | Yes |
| 57 | R -> Q | Yes |
| 123 | Y -> * | No |
| 123 | Y -> | No |
| 136 | N -> D | No |
| 145 | C -> R | No |
| 147 | T -> S | No |
| 164 | N -> S | No |
| 172 | K -> R | Yes |
| 194 | N -> S | No |
| 206 | K -> * | No |
| 233 | N -> K | Yes |
| 249 | D -> A | Yes |
| 258 | A -> | No |
| 258 | A -> S | No |
| 269 | L -> P | Yes |
| 272 | T -> I | No |
| 287 | T -> S | No |

Amino acid mutations

The glycosylation sites of variant protein HSUPARAA_P16 (SEQ ID NO:234), as compared to the known protein Urokinase plasminogen activator surface receptor precursor (SEQ ID NO:216), are described in Table 253 (given according to their position(s) on the amino acid sequence in the first column; the second column indicates whether the glycosylation site is present in the variant protein; and the last column indicates whether the position is different on the variant protein).

TABLE 253

Glycosylation site(s)

| Position(s) on known amino acid sequence | Present in variant protein? | Position(s) on variant protein |
|---|---|---|
| 74 | No | |
| 136 | Yes | 136 |
| 146 | Yes | 146 |
| 174 | Yes | 174 |
| 207 | Yes | 207 |

The variant protein has the following domains, as determined by using InterPro. The domains are described in Table 254:

TABLE 254

InterPro domain(s)

| Domain description | Analysis type | Position(s) on protein |
|---|---|---|
| Urokinase plasminogen activator surface receptor | BlastProDom | 14-55 |
| CD59 antigen | HMMPfam | 23-152, 167-247 |
| CD59 antigen | HMMSmart | 67-159, 166-253 |
| CD59 antigen | ScanRegExp | 24-69, 167-221 |

Variant protein HSUPARAA_P16 (SEQ ID NO:234) is encoded by the following transcript(s): HSUPARAA_T22 (SEQ ID NO:190), for which the sequence(s) is/are given at the end of the application. The coding portion of transcript HSUPARAA_T22 (SEQ ID NO:190) is shown in bold; this coding portion starts at position 428 and ends at position 1288. The transcript also has the following SNPs as listed in Table 255 (given according to their position on the nucleotide sequence, with the alternative nucleic acid listed; the last column indicates whether the SNP is known or not; the presence of known SNPs in variant protein HSUPARAA_P16 (SEQ ID NO:234) sequence provides support for the deduced sequence of this variant protein according to the present invention).

TABLE 255

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 597 | G -> A | Yes |
| 757 | G -> A | No |
| 796 | C -> A | No |
| 796 | C -> | No |
| 833 | A -> G | No |
| 860 | T -> C | No |
| 867 | C -> G | No |
| 918 | A -> G | No |
| 942 | A -> G | Yes |
| 942 | -> G | No |
| 1008 | A -> G | No |
| 1016 | C -> T | No |
| 1027 | C -> T | Yes |
| 1036 | C -> T | Yes |
| 1043 | A -> T | No |
| 1078 | C -> T | Yes |
| 1126 | C -> A | Yes |
| 1173 | A -> C | Yes |
| 1199 | G -> | No |
| 1199 | G -> T | No |
| 1216 | C -> G | No |
| 1233 | T -> C | Yes |
| 1242 | C -> T | No |
| 1279 | C -> A | Yes |
| 1286 | A -> T | No |
| 1330 | G -> A | Yes |
| 1332 | C -> A | No |
| 1332 | C -> | No |
| 1349 | C -> T | Yes |
| 1397 | G -> A | Yes |
| 1404 | C -> T | No |
| 1453 | G -> C | Yes |
| 1482 | G -> | No |

Variant protein HSUPARAA_P20 (SEQ ID NO:235) according to the present invention has an amino acid sequence as given at the end of the application; it is encoded by transcript(s) HSUPARAA_T30 (SEQ ID NO:192).

The localization of the variant protein was determined according to results from a number of different software programs and analyses, including analyses from SignalP and other specialized programs. The variant protein is believed to be located as follows with regard to the cell: secreted.

Variant protein HSUPARAA_P20 (SEQ ID NO:235) also has the following non-silent SNPs (Single Nucleotide Polymorphisms) as listed in Table 256, (given according to their position(s) on the amino acid sequence, with the alternative amino acid(s) listed; the last column indicates whether the SNP is known or not; the presence of known SNPs in variant protein HSUPARAA_P20 (SEQ ID NO:235) sequence provides support for the deduced sequence of this variant protein according to the present invention).

TABLE 256

Amino acid mutations

| SNP position(s) on amino acid sequence | Alternative amino acid(s) | Previously known SNP? |
|---|---|---|
| 17 | V -> | No |
| 55 | E -> G | Yes |
| 62 | P -> T | Yes |
| 104 | A -> T | Yes |
| 106 | K -> I | Yes |
| 150 | Y -> C | Yes |

The glycosylation sites of variant protein HSUPARAA_P20 (SEQ ID NO:235), as compared to the known protein Urokinase plasminogen activator surface receptor precursor (SEQ ID NO:216), are described in Table 257 (given according to their position(s) on the amino acid sequence in the first column; the second column indicates whether the glycosylation site is present in the variant protein; and the last column indicates whether the position is different on the variant protein).

TABLE 257

Glycosylation site(s)

| Position(s) on known amino acid sequence | Present in variant protein? | Position(s) on variant protein |
|---|---|---|
| 74 | No | |
| 184 | No | |
| 194 | No | |
| 222 | No | |
| 255 | No | |

The variant protein has the following domains, as determined by using InterPro. The domains are described in Table 258:

TABLE 258

InterPro domain(s)

| Domain description | Analysis type | Position(s) on protein |
|---|---|---|
| Urokinase plasminogen activator surface receptor | BlastProDom | 14-55 |

Variant protein HSUPARAA_P20 (SEQ ID NO:235) is encoded by the following transcript(s): HSUPARAA_T30 (SEQ ID NO:192), for which the sequence(s) is/are given at the end of the application. The coding portion of transcript HSUPARAA_T30 (SEQ ID NO:192) is shown in bold; this coding portion starts at position 428 and ends at position 955. The transcript also has the following SNPs as listed in Table 259 (given according to their position on the nucleotide sequence, with the alternative nucleic acid listed; the last column indicates whether the SNP is known or not; the presence of known SNPs in variant protein HSUPARAA_P20 (SEQ ID NO:235) sequence provides support for the deduced sequence of this variant protein according to the present invention).

TABLE 259

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 611 | C -> A | Yes |
| 737 | G -> A | Yes |
| 744 | A -> T | Yes |
| 876 | A -> G | Yes |
| 977 | G -> A | Yes |
| 1043 | G -> A | Yes |
| 1117 | C -> A | Yes |
| 1151 | G -> A | Yes |

Variant protein HSUPARAA_P26 (SEQ ID NO:236) according to the present invention has an amino acid sequence as given at the end of the application; it is encoded by transcript(s) HSUPARAA_T4 (SEQ ID NO:180).

The localization of the variant protein was determined according to results from a number of different software programs and analyses, including analyses from SignalP and other specialized programs. The variant protein is believed to be located as follows with regard to the cell: secreted.

Variant protein HSUPARAA_P26 (SEQ ID NO:236) also has the following non-silent SNPs (Single Nucleotide Polymorphisms) as listed in Table 260, (given according to their position(s) on the amino acid sequence, with the alternative amino acid(s) listed; the last column indicates whether the SNP is known or not; the presence of known SNPs in variant protein HSUPARAA_P26 (SEQ ID NO:236) sequence provides support for the deduced sequence of this variant protein according to the present invention).

TABLE 260

Amino acid mutations

| SNP position(s) on amino acid sequence | Alternative amino acid(s) | Previously known SNP? |
|---|---|---|
| 17 | V -> | No |
| 55 | E -> G | Yes |
| 78 | S -> N | No |
| 86 | T -> A | Yes |
| 100 | Q -> | No |

The glycosylation sites of variant protein HSUPARAA_P26 (SEQ ID NO:236), as compared to the known protein Urokinase plasminogen activator surface receptor precursor (SEQ ID NO:216), are described in Table 261 (given according to their position(s) on the amino acid sequence in the first column; the second column indicates whether the glycosylation site is present in the variant protein; and the last column indicates whether the position is different on the variant protein).

TABLE 261

Glycosylation site(s)

| Position(s) on known amino acid sequence | Present in variant protein? | Position(s) on variant protein |
|---|---|---|
| 74 | Yes | 74 |
| 184 | No | |
| 194 | No | |
| 222 | No | |
| 255 | No | |

The variant protein has the following domains, as determined by using InterPro. The domains are described in Table 262:

TABLE 262

InterPro domain(s)

| Domain description | Analysis type | Position(s) on protein |
|---|---|---|
| Urokinase plasminogen activator surface receptor | BlastProDom | 14-98 |
| CD59 antigen | HMMPfam | 23-100 |
| CD59 antigen | HMMSmart | 23-108 |
| CD59 antigen | ScanRegExp | 24-67 |

Variant protein HSUPARAA_P26 (SEQ ID NO:236) is encoded by the following transcript(s): HSUPARAA_T4 (SEQ ID NO:180), for which the sequence(s) is/are given at the end of the application. The coding portion of transcript HSUPARAA_T4 (SEQ ID NO:180) is shown in bold; this coding portion starts at position 428 and ends at position 880. The transcript also has the following SNPs as listed in Table 263 (given according to their position on the nucleotide sequence, with the alternative nucleic acid listed; the last column indicates whether the SNP is known or not; the presence of known SNPs in variant protein HSUPARAA_P26 (SEQ ID NO:236) sequence provides support for the deduced sequence of this variant protein according to the present invention).

TABLE 263

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 591 | A -> G | Yes |
| 649 | C -> T | Yes |
| 660 | G -> A | No |
| 683 | A -> G | Yes |
| 727 | G -> | No |
| 814 | G -> A | Yes |
| 974 | G -> A | No |
| 1013 | C -> A | No |
| 1013 | C -> | No |
| 1050 | A -> G | No |
| 1077 | T -> C | No |
| 1084 | C -> G | No |
| 1135 | A -> G | No |
| 1159 | A -> G | Yes |
| 1159 | -> G | No |

TABLE 263-continued

Nucleic acid SNPs

| SNP position(s) on nucleotide sequence | Alternative nucleic acid(s) | Previously known SNP? |
|---|---|---|
| 1225 | A -> G | No |
| 1233 | C -> T | No |
| 1244 | C -> T | Yes |
| 1253 | C -> T | Yes |
| 1260 | A -> T | No |
| 1295 | C -> T | Yes |
| 1343 | C -> A | Yes |
| 1390 | A -> C | Yes |
| 1416 | G -> | No |
| 1416 | G -> T | No |
| 1433 | C -> G | No |
| 1450 | T -> C | Yes |
| 1459 | C -> T | No |
| 1496 | C -> A | Yes |
| 1503 | A -> T | No |
| 1547 | G -> A | Yes |
| 1549 | C -> A | No |
| 1549 | C -> | No |
| 1566 | C -> T | Yes |
| 1614 | G -> A | Yes |
| 1621 | C -> T | No |
| 1670 | G -> C | Yes |
| 1699 | G -> | No |

Variant protein HSUPARAA_P27 (SEQ ID NO:237) according to the present invention has an amino acid sequence as given at the end of the application; it is encoded by transcript(s) HSUPARAA_T24 (SEQ ID NO:191).

The localization of the variant protein was determined according to results from a number of different software programs and analyses, including analyses from SignalP and other specialized programs. The variant protein is believed to be located as follows with regard to the cell: secreted.

Variant protein HSUPARAA_P27 (SEQ ID NO:237) also has the following non-silent SNPs (Single Nucleotide Polymorphisms) as listed in Table 264, (given according to their position(s) on the amino acid sequence, with the alternative amino acid(s) listed; the last column indicates whether the SNP is known or not; the presence of known SNPs in variant protein HSUPARAA_P27 (SEQ ID NO:237) sequence provides support for the deduced sequence of this variant protein according to the present invention).

TABLE 264

Amino acid mutations

| SNP position(s) on amino acid sequence | Alternative amino acid(s) | Previously known SNP? |
|---|---|---|
| 17 | V -> | No |
| 28 | S -> | No |
| 29 | K -> | No |

The glycosylation sites of variant protein HSUPARAA_P27 (SEQ ID NO:237), as compared to the known protein Urokinase plasminogen activator surface receptor precursor (SEQ ID NO:216), are described in Table 265 (given according to their position(s) on the amino acid sequence in the first column; the second column indicates whether the glycosylation site is present in the variant protein; and the last column indicates whether the position is different on the variant protein).

TABLE 265

Glycosylation site(s)

| Position(s) on known amino acid sequence | Present in variant protein? | Position(s) on variant protein |
|---|---|---|
| 74 | No | |
| 184 | No | |
| 194 | No | |
| 222 | No | |
| 255 | No | |

Variant protein HSUPARAA_P27 (SEQ ID NO:237) is encoded by the following transcript(s): HSUPARAA_T24 (SEQ ID NO:191), for which the sequence(s) is/are given at the end of the application. The coding portion of transcript HSUPARAA_T24 (SEQ ID NO:191) is shown in bold; this coding portion starts at position 428 and ends at position 547. The transcript also has the following SNPs as listed in Table 266 (given according to their position on the nucleotide sequence, with the alternative nucleic acid listed; the last column indicates whether the SNP is known or not; the presence of known SNPs in variant protein HSUPARAA_P27 (SEQ ID NO:237) sequence provides support for the deduced sequence of this variant protein according to the present invention).

TABLE 266

Nucleic acid SNPs

| SNP position(s) on nucleotide sequence | Alternative nucleic acid(s) | Previously known SNP? |
|---|---|---|
| 120 | C -> G | Yes |
| 259 | G -> A | Yes |
| 281 | G -> A | Yes |
| 329 | T -> G | Yes |
| 396 | G -> | No |
| 403 | -> G | No |
| 424 | C -> G | No |
| 478 | C -> | No |
| 511 | A -> | No |
| 512 | A -> | No |
| 622 | C -> T | Yes |
| 954 | G -> A | Yes |
| 1114 | G -> A | No |
| 1153 | C -> A | No |
| 1153 | C -> | No |
| 1190 | A -> G | No |
| 1217 | T -> C | No |
| 1224 | C -> G | No |
| 1275 | A -> G | No |
| 1299 | A -> G | Yes |
| 1299 | -> G | No |
| 1365 | A -> G | No |
| 1373 | C -> T | No |
| 1384 | C -> T | Yes |
| 1393 | C -> T | Yes |
| 1400 | A -> T | No |
| 1435 | C -> T | Yes |
| 1483 | C -> A | Yes |
| 1530 | A -> C | Yes |
| 1556 | G -> | No |
| 1556 | G -> T | No |
| 1573 | C -> G | No |
| 1590 | T -> C | Yes |
| 1599 | C -> T | No |
| 1636 | C -> A | Yes |
| 1643 | A -> T | No |
| 1687 | G -> A | Yes |
| 1689 | C -> A | No |
| 1689 | C -> | No |
| 1706 | C -> T | Yes |
| 1754 | G -> A | Yes |

TABLE 266-continued

Nucleic acid SNPs

| SNP position(s) on nucleotide sequence | Alternative nucleic acid(s) | Previously known SNP? |
|---|---|---|
| 1761 | C -> T | No |
| 1810 | G -> C | Yes |
| 1839 | G -> | No |

As noted above, cluster HSUPARAA features 23 segment(s), which were listed in Table 212 above and for which the sequence(s) are given at the end of the application. These segment(s) are portions of nucleic acid sequence(s) which are described herein separately because they are of particular interest. A description of each segment according to the present invention is now provided.

Segment cluster HSUPARAA_N0 (SEQ ID NO:193) according to the present invention is supported by 164 libraries. The number of libraries was determined as previously described. This segment can be found in the following transcript(s): HSUPARAA_T10 (SEQ ID NO:181), HSUPARAA_T11 (SEQ ID NO:182), HSUPARAA_T14 (SEQ ID NO:183), HSUPARAA_T15 (SEQ ID NO:184), HSUPARAA_T16 (SEQ ID NO:185), HSUPARAA_T17 (SEQ ID NO:186), HSUPARAA_T19 (SEQ ID NO:187), HSUPARAA_T2 (SEQ ID NO:178), HSUPARAA_T20 (SEQ ID NO:188), HSUPARAA_T21 (SEQ ID NO:189), HSUPARAA_T22 (SEQ ID NO:190), HSUPARAA_T24 (SEQ ID NO:191), HSUPARAA_T3 (SEQ ID NO:179), HSUPARAA_T30 (SEQ ID NO:192) and HSUPARAA_T4 (SEQ ID NO:180). Table 267 below describes the starting and ending position of this segment on each transcript.

TABLE 267

Segment location on transcripts

| Transcript name | Segment starting position | Segment ending position |
|---|---|---|
| HSUPARAA_T10 (SEQ ID NO: 181) | 1 | 482 |
| HSUPARAA_T11 (SEQ ID NO: 182) | 1 | 482 |
| HSUPARAA_T14 (SEQ ID NO: 183) | 1 | 482 |
| HSUPARAA_T15 (SEQ ID NO: 184) | 1 | 482 |
| HSUPARAA_T16 (SEQ ID NO: 185) | 1 | 482 |
| HSUPARAA_T17 (SEQ ID NO: 186) | 1 | 482 |
| HSUPARAA_T19 (SEQ ID NO: 187) | 1 | 482 |
| HSUPARAA_T2 (SEQ ID NO: 178) | 1 | 482 |
| HSUPARAA_T20 (SEQ ID NO: 188) | 1 | 482 |
| HSUPARAA_T21 (SEQ ID NO: 189) | 1 | 482 |
| HSUPARAA_T22 (SEQ ID NO: 190) | 1 | 482 |
| HSUPARAA_T24 (SEQ ID NO: 191) | 1 | 482 |
| HSUPARAA_T3 (SEQ ID NO: 179) | 1 | 482 |
| HSUPARAA_T30 (SEQ ID NO: 192) | 1 | 482 |
| HSUPARAA_T4 (SEQ ID NO: 180) | 1 | 482 |

Segment cluster HSUPARAA_N9 (SEQ ID NO:194) according to the present invention is supported by 5 libraries. The number of libraries was determined as previously described. This segment can be found in the following transcript(s): HSUPARAA_T30 (SEQ ID NO:192). Table 268 below describes the starting and ending position of this segment on each transcript.

TABLE 268

Segment location on transcripts

| Transcript name | Segment starting position | Segment ending position |
|---|---|---|
| HSUPARAA_T30 (SEQ ID NO: 192) | 594 | 1171 |

Segment cluster HSUPARAA_N13 (SEQ ID NO:195) according to the present invention is supported by 188 libraries. The number of libraries was determined as previously described. This segment can be found in the following transcript(s): HSUPARAA_T10 (SEQ ID NO:181), HSUPARAA_T11 (SEQ ID NO:182), HSUPARAA_T14 (SEQ ID NO:183), HSUPARAA_T15 (SEQ ID NO:184), HSUPARAA_T16 (SEQ ID NO:185), HSUPARAA_T17 (SEQ ID NO:186), HSUPARAA_T19 (SEQ ID NO:187), HSUPARAA_T2 (SEQ ID NO:178), HSUPARAA_T20 (SEQ ID NO:188), HSUPARAA_T21 (SEQ ID NO:189), HSUPARAA_T3 (SEQ ID NO:179) and HSUPARAA_T4 (SEQ ID NO:180). Table 269 below describes the starting and ending position of this segment on each transcript.

TABLE 269

Segment location on transcripts

| Transcript name | Segment starting position | Segment ending position |
|---|---|---|
| HSUPARAA_T10 (SEQ ID NO: 181) | 612 | 752 |
| HSUPARAA_T11 (SEQ ID NO: 182) | 597 | 737 |
| HSUPARAA_T14 (SEQ ID NO: 183) | 597 | 737 |
| HSUPARAA_T15 (SEQ ID NO: 184) | 597 | 737 |
| HSUPARAA_T16 (SEQ ID NO: 185) | 597 | 737 |
| HSUPARAA_T17 (SEQ ID NO: 186) | 597 | 737 |
| HSUPARAA_T19 (SEQ ID NO: 187) | 597 | 737 |
| HSUPARAA_T2 (SEQ ID NO: 178) | 597 | 737 |
| HSUPARAA_T20 (SEQ ID NO: 188) | 597 | 737 |
| HSUPARAA_T21 (SEQ ID NO: 189) | 597 | 737 |
| HSUPARAA_T3 (SEQ ID NO: 179) | 597 | 737 |
| HSUPARAA_T4 (SEQ ID NO: 180) | 597 | 737 |

Segment cluster HSUPARAA_N16 (SEQ ID NO:196) according to the present invention is supported by 19 libraries. The number of libraries was determined as previously described. This segment can be found in the following transcript(s): HSUPARAA_T24 (SEQ ID NO:191). Table 270 below describes the starting and ending position of this segment on each transcript.

TABLE 270

Segment location on transcripts

| Transcript name | Segment starting position | Segment ending position |
|---|---|---|
| HSUPARAA_T24 (SEQ ID NO: 191) | 483 | 950 |

Segment cluster HSUPARAA_N22 (SEQ ID NO:197) according to the present invention is supported by 155 libraries. The number of libraries was determined as previously described. This segment can be found in the following transcript(s): HSUPARAA_T10 (SEQ ID NO:181), HSUPARAA_T11 (SEQ ID NO:182), HSUPARAA_T14 (SEQ ID NO:183), HSUPARAA_T15 (SEQ ID NO:184), HSU- PARAA_T16 (SEQ ID NO:185), HSUPARAA_T17 (SEQ ID NO:186), HSUPARAA_T19 (SEQ ID NO:187), HSUPARAA_T2 (SEQ ID NO:178), HSUPARAA_T20 (SEQ ID NO:188), HSUPARAA_T21 (SEQ ID NO:189), HSUPARAA_T22 (SEQ ID NO:190), HSUPARAA_T24 (SEQ ID NO:191), HSUPARAA_T3 (SEQ ID NO:179) and HSUPARAA_T4 (SEQ ID NO:180). Table 271 below describes the starting and ending position of this segment on each transcript.

TABLE 271

Segment location on transcripts

| Transcript name | Segment starting position | Segment ending position |
|---|---|---|
| HSUPARAA_T10 (SEQ ID NO: 181) | 753 | 905 |
| HSUPARAA_T11 (SEQ ID NO: 182) | 738 | 890 |
| HSUPARAA_T14 (SEQ ID NO: 183) | 738 | 890 |
| HSUPARAA_T15 (SEQ ID NO: 184) | 738 | 890 |
| HSUPARAA_T16 (SEQ ID NO: 185) | 738 | 890 |
| HSUPARAA_T17 (SEQ ID NO: 186) | 738 | 890 |
| HSUPARAA_T19 (SEQ ID NO: 187) | 738 | 890 |
| HSUPARAA_T2 (SEQ ID NO: 178) | 738 | 890 |
| HSUPARAA_T20 (SEQ ID NO: 188) | 738 | 890 |
| HSUPARAA_T21 (SEQ ID NO: 189) | 738 | 890 |
| HSUPARAA_T22 (SEQ ID NO: 190) | 594 | 746 |
| HSUPARAA_T24 (SEQ ID NO: 191) | 951 | 1103 |
| HSUPARAA_T3 (SEQ ID NO: 179) | 738 | 890 |
| HSUPARAA_T4 (SEQ ID NO: 180) | 811 | 963 |

Segment cluster HSUPARAA_N27 (SEQ ID NO:198) according to the present invention is supported by 148 libraries. The number of libraries was determined as previously described. This segment can be found in the following transcript(s): HSUPARAA_T10 (SEQ ID NO:181), HSUPARAA_T11 (SEQ ID NO:182), HSUPARAA_T14 (SEQ ID NO:183), HSUPARAA_T15 (SEQ ID NO:184), HSUPARAA_T16 (SEQ ID NO:185), HSUPARAA_T17 (SEQ ID NO:186), HSUPARAA_T19 (SEQ ID NO:187), HSUPARAA_T2 (SEQ ID NO:178), HSUPARAA_T20 (SEQ ID NO:188), HSUPARAA_T21 (SEQ ID NO:189), HSUPARAA_T22 (SEQ ID NO:190), HSUPARAA_T24 (SEQ ID NO:191), HSUPARAA_T3 (SEQ ID NO:179) and HSUPARAA_T4 (SEQ ID NO:180). Table 272 below describes the starting and ending position of this segment on each transcript.

TABLE 272

Segment location on transcripts

| Transcript name | Segment starting position | Segment ending position |
|---|---|---|
| HSUPARAA_T10 (SEQ ID NO: 181) | 915 | 1049 |
| HSUPARAA_T11 (SEQ ID NO: 182) | 891 | 1025 |
| HSUPARAA_T14 (SEQ ID NO: 183) | 900 | 1034 |
| HSUPARAA_T15 (SEQ ID NO: 184) | 900 | 1034 |
| HSUPARAA_T16 (SEQ ID NO: 185) | 900 | 1034 |
| HSUPARAA_T17 (SEQ ID NO: 186) | 900 | 1034 |
| HSUPARAA_T19 (SEQ ID NO: 187) | 900 | 1034 |
| HSUPARAA_T2 (SEQ ID NO: 178) | 900 | 1034 |
| HSUPARAA_T20 (SEQ ID NO: 188) | 900 | 1034 |
| HSUPARAA_T21 (SEQ ID NO: 189) | 900 | 1034 |
| HSUPARAA_T22 (SEQ ID NO: 190) | 756 | 890 |
| HSUPARAA_T24 (SEQ ID NO: 191) | 1113 | 1247 |
| HSUPARAA_T3 (SEQ ID NO: 179) | 900 | 1034 |
| HSUPARAA_T4 (SEQ ID NO: 180) | 973 | 1107 |

Segment cluster HSUPARAA_N35 (SEQ ID NO:199) according to the present invention is supported by 3 libraries. The number of libraries was determined as previously described. This segment can be found in the following transcript(s): HSUPARAA_T19 (SEQ ID NO:187). Table 273 below describes the starting and ending position of this segment on each transcript.

TABLE 273

Segment location on transcripts

| Transcript name | Segment starting position | Segment ending position |
|---|---|---|
| HSUPARAA_T19 (SEQ ID NO: 187) | 1182 | 1546 |

Segment cluster HSUPARAA_N38 (SEQ ID NO:200) according to the present invention is supported by 179 libraries. The number of libraries was determined as previously described. This segment can be found in the following transcript(s): HSUPARAA_T10 (SEQ ID NO:181), HSUPARAA_T11 (SEQ ID NO:182), HSUPARAA_T2 (SEQ ID NO:178), HSUPARAA_T20 (SEQ ID NO:188), HSUPARAA_T21 (SEQ ID NO:189), HSUPARAA_T22 (SEQ ID NO:190), HSUPARAA_T24 (SEQ ID NO:191), HSUPARAA_T3 (SEQ ID NO:179) and HSUPARAA_T4 (SEQ ID NO:180). Table 274 below describes the starting and ending position of this segment on each transcript.

TABLE 274

Segment location on transcripts

| Transcript name | Segment starting position | Segment ending position |
|---|---|---|
| HSUPARAA_T10 (SEQ ID NO: 181) | 1197 | 1376 |
| HSUPARAA_T11 (SEQ ID NO: 182) | 1173 | 1352 |
| HSUPARAA_T2 (SEQ ID NO: 178) | 1202 | 1381 |
| HSUPARAA_T20 (SEQ ID NO: 188) | 1035 | 1214 |
| HSUPARAA_T21 (SEQ ID NO: 189) | 1055 | 1234 |
| HSUPARAA_T22 (SEQ ID NO: 190) | 1038 | 1217 |
| HSUPARAA_T24 (SEQ ID NO: 191) | 1395 | 1574 |
| HSUPARAA_T3 (SEQ ID NO: 179) | 1195 | 1374 |
| HSUPARAA_T4 (SEQ ID NO: 180) | 1255 | 1434 |

Segment cluster HSUPARAA_N40 (SEQ ID NO:201) according to the present invention is supported by 170 libraries. The number of libraries was determined as previously described. This segment can be found in the following transcript(s): HSUPARAA_T10 (SEQ ID NO:181), HSUPARAA_T11 (SEQ ID NO:182), HSUPARAA_T2 (SEQ ID NO:178), HSUPARAA_T20 (SEQ ID NO:188), HSUPARAA_T21 (SEQ ID NO:189), HSUPARAA_T22 (SEQ ID NO:190), HSUPARAA_T24 (SEQ ID NO:191), HSUPARAA_T3 (SEQ ID NO:179) and HSUPARAA_T4 (SEQ ID NO:180). Table 275 below describes the starting and ending position of this segment on each transcript.

TABLE 275

Segment location on transcripts

| Transcript name | Segment starting position | Segment ending position |
|---|---|---|
| HSUPARAA_T10 (SEQ ID NO: 181) | 1435 | 1769 |
| HSUPARAA_T11 (SEQ ID NO: 182) | 1411 | 1745 |
| HSUPARAA_T2 (SEQ ID NO: 178) | 1440 | 1774 |

TABLE 275-continued

Segment location on transcripts

| Transcript name | Segment starting position | Segment ending position |
|---|---|---|
| HSUPARAA_T20 (SEQ ID NO: 188) | 1273 | 1607 |
| HSUPARAA_T21 (SEQ ID NO: 189) | 1293 | 1627 |
| HSUPARAA_T22 (SEQ ID NO: 190) | 1276 | 1610 |
| HSUPARAA_T24 (SEQ ID NO: 191) | 1633 | 1967 |
| HSUPARAA_T3 (SEQ ID NO: 179) | 1433 | 1767 |
| HSUPARAA_T4 (SEQ ID NO: 180) | 1493 | 1827 |

Segment cluster HSUPARAA_N43 (SEQ ID NO:202) according to the present invention is supported by 37 libraries. The number of libraries was determined as previously described. This segment can be found in the following transcript(s): HSUPARAA_T14 (SEQ ID NO:183), HSUPARAA_T15 (SEQ ID NO:184), HSUPARAA_T16 (SEQ ID NO:185) and HSUPARAA_T17 (SEQ ID NO:186). Table 276 below describes the starting and ending position of this segment on each transcript.

TABLE 276

Segment location on transcripts

| Transcript name | Segment starting position | Segment ending position |
|---|---|---|
| HSUPARAA_T14 (SEQ ID NO: 183) | 1182 | 1457 |
| HSUPARAA_T15 (SEQ ID NO: 184) | 1182 | 1537 |
| HSUPARAA_T16 (SEQ ID NO: 185) | 1182 | 1537 |
| HSUPARAA_T17 (SEQ ID NO: 186) | 1182 | 1537 |

Segment cluster HSUPARAA_N44 (SEQ ID NO:203) according to the present invention is supported by 7 libraries. The number of libraries was determined as previously described. This segment can be found in the following transcript(s): HSUPARAA_T15 (SEQ ID NO:184) and HSUPARAA_T16 (SEQ ID NO:185). Table 277 below describes the starting and ending position of this segment on each transcript.

TABLE 277

Segment location on transcripts

| Transcript name | Segment starting position | Segment ending position |
|---|---|---|
| HSUPARAA_T15 (SEQ ID NO: 184) | 1538 | 1635 |
| HSUPARAA_T16 (SEQ ID NO: 185) | 1538 | 1673 |

Segment cluster HSUPARAA_N45 (SEQ ID NO:204) according to the present invention is supported by 4 libraries. The number of libraries was determined as previously described. This segment can be found in the following transcript(s): HSUPARAA_T16 (SEQ ID NO:185) and HSUPARAA_T17 (SEQ ID NO:186). Table 278 below describes the starting and ending position of this segment on each transcript.

TABLE 278

Segment location on transcripts

| Transcript name | Segment starting position | Segment ending position |
|---|---|---|
| HSUPARAA_T16 (SEQ ID NO: 185) | 1674 | 2077 |
| HSUPARAA_T17 (SEQ ID NO: 186) | 1538 | 1941 |

According to an optional embodiment of the present invention, short segments related to the above cluster are also provided. These segments are up to about 120 bp in length, and so are included in a separate description.

Segment cluster HSUPARAA_N7 (SEQ ID NO:205) according to the present invention is supported by 178 libraries. The number of libraries was determined as previously described. This segment can be found in the following transcript(s): HSUPARAA_T10 (SEQ ID NO:181), HSUPARAA_T11 (SEQ ID NO:182), HSUPARAA_T14 (SEQ ID NO:183), HSUPARAA_T15 (SEQ ID NO:184), HSUPARAA_T16 (SEQ ID NO:185), HSUPARAA_T17 (SEQ ID NO:186), HSUPARAA_T19 (SEQ ID NO:187), HSUPARAA_T2 (SEQ ID NO:178), HSUPARAA_T20 (SEQ ID NO:188), HSUPARAA_T21 (SEQ ID NO:189), HSUPARAA_T22 (SEQ ID NO:190), HSUPARAA_T3 (SEQ ID NO:179), HSUPARAA_T30 (SEQ ID NO:192) and HSUPARAA_T4 (SEQ ID NO:180). Table 279 below describes the starting and ending position of this segment on each transcript.

TABLE 279

Segment location on transcripts

| Transcript name | Segment starting position | Segment ending position |
|---|---|---|
| HSUPARAA_T10 (SEQ ID NO: 181) | 483 | 547 |
| HSUPARAA_T11 (SEQ ID NO: 182) | 483 | 547 |
| HSUPARAA_T14 (SEQ ID NO: 183) | 483 | 547 |
| HSUPARAA_T15 (SEQ ID NO: 184) | 483 | 547 |
| HSUPARAA_T16 (SEQ ID NO: 185) | 483 | 547 |
| HSUPARAA_T17 (SEQ ID NO: 186) | 483 | 547 |
| HSUPARAA_T19 (SEQ ID NO: 187) | 483 | 547 |
| HSUPARAA_T2 (SEQ ID NO: 178) | 483 | 547 |
| HSUPARAA_T20 (SEQ ID NO: 188) | 483 | 547 |
| HSUPARAA_T21 (SEQ ID NO: 189) | 483 | 547 |
| HSUPARAA_T22 (SEQ ID NO: 190) | 483 | 547 |
| HSUPARAA_T3 (SEQ ID NO: 179) | 483 | 547 |
| HSUPARAA_T30 (SEQ ID NO: 192) | 483 | 547 |
| HSUPARAA_T4 (SEQ ID NO: 180) | 483 | 547 |

Segment cluster HSUPARAA_N8 (SEQ ID NO:206) according to the present invention is supported by 181 libraries. The number of libraries was determined as previously described. This segment can be found in the following transcript(s): HSUPARAA_T10 (SEQ ID NO:181), HSUPARAA_T11 (SEQ ID NO:182), HSUPARAA_T14 (SEQ ID NO:183), HSUPARAA_T15 (SEQ ID NO:184), HSUPARAA_T16 (SEQ ID NO:185), HSUPARAA_T17 (SEQ ID NO:186), HSUPARAA_T19 (SEQ ID NO:187), HSUPARAA_T2 (SEQ ID NO:178), HSUPARAA_T20 (SEQ ID NO:188), HSUPARAA_T21 (SEQ ID NO:189), HSUPARAA_T22 (SEQ ID NO:190), HSUPARAA_T3 (SEQ ID NO:179), HSUPARAA_T30 (SEQ ID NO:192) and HSUPARAA_T4 (SEQ ID NO:180). Table 280 below describes the starting and ending position of this segment on each transcript.

TABLE 280

Segment location on transcripts

| Transcript name | Segment starting position | Segment ending position |
|---|---|---|
| HSUPARAA_T10 (SEQ ID NO: 181) | 548 | 593 |
| HSUPARAA_T11 (SEQ ID NO: 182) | 548 | 593 |
| HSUPARAA_T14 (SEQ ID NO: 183) | 548 | 593 |
| HSUPARAA_T15 (SEQ ID NO: 184) | 548 | 593 |
| HSUPARAA_T16 (SEQ ID NO: 185) | 548 | 593 |
| HSUPARAA_T17 (SEQ ID NO: 186) | 548 | 593 |
| HSUPARAA_T19 (SEQ ID NO: 187) | 548 | 593 |
| HSUPARAA_T2 (SEQ ID NO: 178) | 548 | 593 |
| HSUPARAA_T20 (SEQ ID NO: 188) | 548 | 593 |
| HSUPARAA_T21 (SEQ ID NO: 189) | 548 | 593 |
| HSUPARAA_T22 (SEQ ID NO: 190) | 548 | 593 |
| HSUPARAA_T3 (SEQ ID NO: 179) | 548 | 593 |
| HSUPARAA_T30 (SEQ ID NO: 192) | 548 | 593 |
| HSUPARAA_T4 (SEQ ID NO: 180) | 548 | 593 |

Segment cluster HSUPARAA_N11 (SEQ ID NO:207) according to the present invention is supported by 1 libraries. The number of libraries was determined as previously described. This segment can be found in the following transcript(s): HSUPARAA_T10 (SEQ ID NO:181). Table 281 below describes the starting and ending position of this segment on each transcript.

TABLE 281

Segment location on transcripts

| Transcript name | Segment starting position | Segment ending position |
|---|---|---|
| HSUPARAA_T10 (SEQ ID NO: 181) | 594 | 608 |

Segment cluster HSUPARAA_N12 (SEQ ID NO:208) according to the present invention is supported by 176 libraries. The number of libraries was determined as previously described. This segment can be found in the following transcript(s): HSUPARAA_T10 (SEQ ID NO:181), HSUPARAA_T11 (SEQ ID NO:182), HSUPARAA_T14 (SEQ ID NO:183), HSUPARAA_T15 (SEQ ID NO:184), HSUPARAA_T16 (SEQ ID NO:185), HSUPARAA_T17 (SEQ ID NO:186), HSUPARAA_T19 (SEQ ID NO:187), HSUPARAA_T2 (SEQ ID NO:178), HSUPARAA_T20 (SEQ ID NO:188), HSUPARAA_T21 (SEQ ID NO:189), HSUPARAA_T3 (SEQ ID NO:179) and HSUPARAA_T4 (SEQ ID NO:180). Table 282 below describes the starting and ending position of this segment on each transcript.

TABLE 282

Segment location on transcripts

| Transcript name | Segment starting position | Segment ending position |
|---|---|---|
| HSUPARAA_T10 (SEQ ID NO: 181) | 609 | 611 |
| HSUPARAA_T11 (SEQ ID NO: 182) | 594 | 596 |
| HSUPARAA_T14 (SEQ ID NO: 183) | 594 | 596 |
| HSUPARAA_T15 (SEQ ID NO: 184) | 594 | 596 |
| HSUPARAA_T16 (SEQ ID NO: 185) | 594 | 596 |
| HSUPARAA_T17 (SEQ ID NO: 186) | 594 | 596 |
| HSUPARAA_T19 (SEQ ID NO: 187) | 594 | 596 |
| HSUPARAA_T2 (SEQ ID NO: 178) | 594 | 596 |
| HSUPARAA_T20 (SEQ ID NO: 188) | 594 | 596 |
| HSUPARAA_T21 (SEQ ID NO: 189) | 594 | 596 |
| HSUPARAA_T3 (SEQ ID NO: 179) | 594 | 596 |
| HSUPARAA_T4 (SEQ ID NO: 180) | 594 | 596 |

Segment cluster HSUPARAA_N19 (SEQ ID NO:209) according to the present invention is supported by 3 libraries. The number of libraries was determined as previously described. This segment can be found in the following transcript(s): HSUPARAA_T4 (SEQ ID NO:180). Table 283 below describes the starting and ending position of this segment on each transcript.

TABLE 283

Segment location on transcripts

| Transcript name | Segment starting position | Segment ending position |
|---|---|---|
| HSUPARAA_T4 (SEQ ID NO: 180) | 738 | 810 |

Segment cluster HSUPARAA_N23 (SEQ ID NO:210) according to the present invention is supported by 121 libraries. The number of libraries was determined as previously described. This segment can be found in the following transcript(s): HSUPARAA_T10 (SEQ ID NO:181), HSUPARAA_T14 (SEQ ID NO:183), HSUPARAA_T15 (SEQ ID NO:184), HSUPARAA_T16 (SEQ ID NO:185), HSUPARAA_T17 (SEQ ID NO:186), HSUPARAA_T19 (SEQ ID NO:187), HSUPARAA_T2 (SEQ ID NO:178), HSUPARAA_T20 (SEQ ID NO:188), HSUPARAA_T21 (SEQ ID NO:189), HSUPARAA_T22 (SEQ ID NO:190), HSUPARAA_T24 (SEQ ID NO:191), HSUPARAA_T3 (SEQ ID NO:179) and HSUPARAA_T4 (SEQ ID NO:180). Table 284 below describes the starting and ending position of this segment on each transcript.

TABLE 284

Segment location on transcripts

| Transcript name | Segment starting position | Segment ending position |
|---|---|---|
| HSUPARAA_T10 (SEQ ID NO: 181) | 906 | 914 |
| HSUPARAA_T14 (SEQ ID NO: 183) | 891 | 899 |
| HSUPARAA_T15 (SEQ ID NO: 184) | 891 | 899 |
| HSUPARAA_T16 (SEQ ID NO: 185) | 891 | 899 |
| HSUPARAA_T17 (SEQ ID NO: 186) | 891 | 899 |
| HSUPARAA_T19 (SEQ ID NO: 187) | 891 | 899 |
| HSUPARAA_T2 (SEQ ID NO: 178) | 891 | 899 |
| HSUPARAA_T20 (SEQ ID NO: 188) | 891 | 899 |
| HSUPARAA_T21 (SEQ ID NO: 189) | 891 | 899 |
| HSUPARAA_T22 (SEQ ID NO: 190) | 747 | 755 |
| HSUPARAA_T24 (SEQ ID NO: 191) | 1104 | 1112 |
| HSUPARAA_T3 (SEQ ID NO: 179) | 891 | 899 |
| HSUPARAA_T4 (SEQ ID NO: 180) | 964 | 972 |

Segment cluster HSUPARAA_N28 (SEQ ID NO:211) according to the present invention is supported by 5 libraries. The number of libraries was determined as previously described. This segment can be found in the following transcript(s): HSUPARAA_T2 (SEQ ID NO:178) and HSU- PARAA_T21 (SEQ ID NO:189). Table 285 below describes the starting and ending position of this segment on each transcript.

TABLE 285

Segment location on transcripts

| Transcript name | Segment starting position | Segment ending position |
|---|---|---|
| HSUPARAA_T2 (SEQ ID NO: 178) | 1035 | 1054 |
| HSUPARAA_T21 (SEQ ID NO: 189) | 1035 | 1054 |

Segment cluster HSUPARAA_N31 (SEQ ID NO:212) according to the present invention is supported by 5 libraries. The number of libraries was determined as previously described. This segment can be found in the following transcript(s): HSUPARAA_T3 (SEQ ID NO:179). Table 286 below describes the starting and ending position of this segment on each transcript.

TABLE 286

Segment location on transcripts

| Transcript name | Segment starting position | Segment ending position |
|---|---|---|
| HSUPARAA_T3 (SEQ ID NO: 179) | 1035 | 1047 |

Segment cluster HSUPARAA_N32 (SEQ ID NO:213) according to the present invention is supported by 164 libraries. The number of libraries was determined as previously described. This segment can be found in the following transcript(s): HSUPARAA_T10 (SEQ ID NO:181), HSUPARAA_T11 (SEQ ID NO:182), HSUPARAA_T14 (SEQ ID NO:183), HSUPARAA_T15 (SEQ ID NO:184), HSUPARAA_T16 (SEQ ID NO:185), HSUPARAA_T17 (SEQ ID NO:186), HSUPARAA_T19 (SEQ ID NO:187), HSUPARAA_T2 (SEQ ID NO:178), HSUPARAA_T22 (SEQ ID NO:190), HSUPARAA_T24 (SEQ ID NO:191), HSUPARAA_T3 (SEQ ID NO:179) and HSUPARAA_T4 (SEQ ID NO:180). Table 287 below describes the starting and ending position of this segment on each transcript.

TABLE 287

Segment location on transcripts

| Transcript name | Segment starting position | Segment ending position |
|---|---|---|
| HSUPARAA_T10 (SEQ ID NO: 181) | 1050 | 1160 |
| HSUPARAA_T11 (SEQ ID NO: 182) | 1026 | 1136 |
| HSUPARAA_T14 (SEQ ID NO: 183) | 1035 | 1145 |
| HSUPARAA_T15 (SEQ ID NO: 184) | 1035 | 1145 |
| HSUPARAA_T16 (SEQ ID NO: 185) | 1035 | 1145 |
| HSUPARAA_T17 (SEQ ID NO: 186) | 1035 | 1145 |
| HSUPARAA_T19 (SEQ ID NO: 187) | 1035 | 1145 |
| HSUPARAA_T2 (SEQ ID NO: 178) | 1055 | 1165 |
| HSUPARAA_T22 (SEQ ID NO: 190) | 891 | 1001 |
| HSUPARAA_T24 (SEQ ID NO: 191) | 1248 | 1358 |
| HSUPARAA_T3 (SEQ ID NO: 179) | 1048 | 1158 |
| HSUPARAA_T4 (SEQ ID NO: 180) | 1108 | 1218 |

Segment cluster HSUPARAA_N33 (SEQ ID NO:214) according to the present invention is supported by 160 libraries. The number of libraries was determined as previously described. This segment can be found in the following transcript(s): HSUPARAA_T10 (SEQ ID NO:181), HSUPARAA_T11 (SEQ ID NO:182), HSUPARAA_T14 (SEQ ID NO:183), HSUPARAA_T15 (SEQ ID NO:184), HSUPARAA_T16 (SEQ ID NO:185), HSUPARAA_T17 (SEQ ID NO:186), HSUPARAA_T19 (SEQ ID NO:187), HSUPARAA_T2 (SEQ ID NO:178), HSUPARAA_T22 (SEQ ID NO:190), HSUPARAA_T24 (SEQ ID NO:191), HSUPARAA_T3 (SEQ ID NO:179) and HSUPARAA_T4 (SEQ ID NO:180). Table 288 below describes the starting and ending position of this segment on each transcript.

TABLE 288

Segment location on transcripts

| Transcript name | Segment starting position | Segment ending position |
|---|---|---|
| HSUPARAA_T10 (SEQ ID NO: 181) | 1161 | 1196 |
| HSUPARAA_T11 (SEQ ID NO: 182) | 1137 | 1172 |
| HSUPARAA_T14 (SEQ ID NO: 183) | 1146 | 1181 |
| HSUPARAA_T15 (SEQ ID NO: 184) | 1146 | 1181 |
| HSUPARAA_T16 (SEQ ID NO: 185) | 1146 | 1181 |
| HSUPARAA_T17 (SEQ ID NO: 186) | 1146 | 1181 |
| HSUPARAA_T19 (SEQ ID NO: 187) | 1146 | 1181 |
| HSUPARAA_T2 (SEQ ID NO: 178) | 1166 | 1201 |
| HSUPARAA_T22 (SEQ ID NO: 190) | 1002 | 1037 |
| HSUPARAA_T24 (SEQ ID NO: 191) | 1359 | 1394 |
| HSUPARAA_T3 (SEQ ID NO: 179) | 1159 | 1194 |
| HSUPARAA_T4 (SEQ ID NO: 180) | 1219 | 1254 |

Segment cluster HSUPARAA_N39 (SEQ ID NO:215) according to the present invention is supported by 157 libraries. The number of libraries was determined as previously described. This segment can be found in the following transcript(s): HSUPARAA_T10 (SEQ ID NO:181), HSUPARAA_T11 (SEQ ID NO:182), HSUPARAA_T2 (SEQ ID NO:178), HSUPARAA_T20 (SEQ ID NO:188), HSUPARAA_T21 (SEQ ID NO:189), HSUPARAA_T22 (SEQ ID NO:190), HSUPARAA_T24 (SEQ ID NO:191), HSUPARAA_T3 (SEQ ID NO:179) and HSUPARAA_T4 (SEQ ID NO:180). Table 289 below describes the starting and ending position of this segment on each transcript.

TABLE 289

Segment location on transcripts

| Transcript name | Segment starting position | Segment ending position |
|---|---|---|
| HSUPARAA_T10 (SEQ ID NO: 181) | 1377 | 1434 |
| HSUPARAA_T11 (SEQ ID NO: 182) | 1353 | 1410 |
| HSUPARAA_T2 (SEQ ID NO: 178) | 1382 | 1439 |
| HSUPARAA_T20 (SEQ ID NO: 188) | 1215 | 1272 |
| HSUPARAA_T21 (SEQ ID NO: 189) | 1235 | 1292 |
| HSUPARAA_T22 (SEQ ID NO: 190) | 1218 | 1275 |
| HSUPARAA_T24 (SEQ ID NO: 191) | 1575 | 1632 |
| HSUPARAA_T3 (SEQ ID NO: 179) | 1375 | 1432 |
| HSUPARAA_T4 (SEQ ID NO: 180) | 1435 | 1492 |

The alignment of HSUPARAA variant proteins to the previously known proteins is shown in the attached CD-Rom. Expression of *Homo sapiens* plasminogen activator, urokinase receptor (PLAUR) HSUPARAA transcripts which are detectable by amplicon as depicted in sequence name HSUPARAA seg22 (SEQ ID NO:484) in normal and cancerous lung tissues:

Expression of *Homo sapiens* plasminogen activator, urokinase receptor (PLAUR) transcripts detectable by or according to seg22, HSUPARAA seg22 (SEQ ID NO:484) amplicon and primers HSUPARAA seg22F (SEQ ID NO:482) and HSUPARAA seg22R (SEQ ID NO:483) was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), Ubiquitin (GenBank Accession No. BC000449 (SEQ ID NO:458); amplicon—Ubiquitin-amplicon (SEQ ID NO:461)) and SDHA (GenBank Accession No. NM_004168 (SEQ ID NO:462); amplicon—SDHA-amplicon (SEQ ID NO:465)), was measured similarly. For each RT sample, the Primer pairs are also optionally and preferably encompassed within the present invention; for example, for the above experiment, the following primer pair was used as a non-limiting illustrative example only of a suitable primer pair: HSUPARAA seg22 forward primer (SEQ ID NO:482); and HSUPARAA seg22 reverse primer (SEQ ID NO:483).

The present invention also preferably encompasses any amplicon obtained through the use of any suitable primer pair; for example, for the above experiment, the following amplicon was obtained as a non-limiting illustrative example only of a suitable amplicon: HSUPARAA seg22 (SEQ ID NO:484).

```
Primers:
Forward primer HSUPARAA seg22 (SEQ ID NO: 482):
CCGGGCTGTCACCTATTCC Reverse primer HSUPARAA seg22 (SEQ ID NO: 483):
GCACTGTTCTTCAGGGCTGC Amplicon HSUPARAA seg22 (SEQ ID NO: 484):
CCGGGCTGTCACCTATTCCCGAAGCCGTTACCTCGAATGCATTTCCTGTGGCTCATCA

GACATGAGCTGTGAGAGGGGCCGGCACCAGAGCCTGCAGTGCCGCAGCCCTGAAGAA

CAGTGC
``` expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2_4) for which values are presented in FIG. 17A. Then the reciprocal of this ratio was calculated, to obtain a value of fold down-regulation for each sample relative to median of the normal PM samples, for which values are presented in FIG. 17B.

Figure 17A:
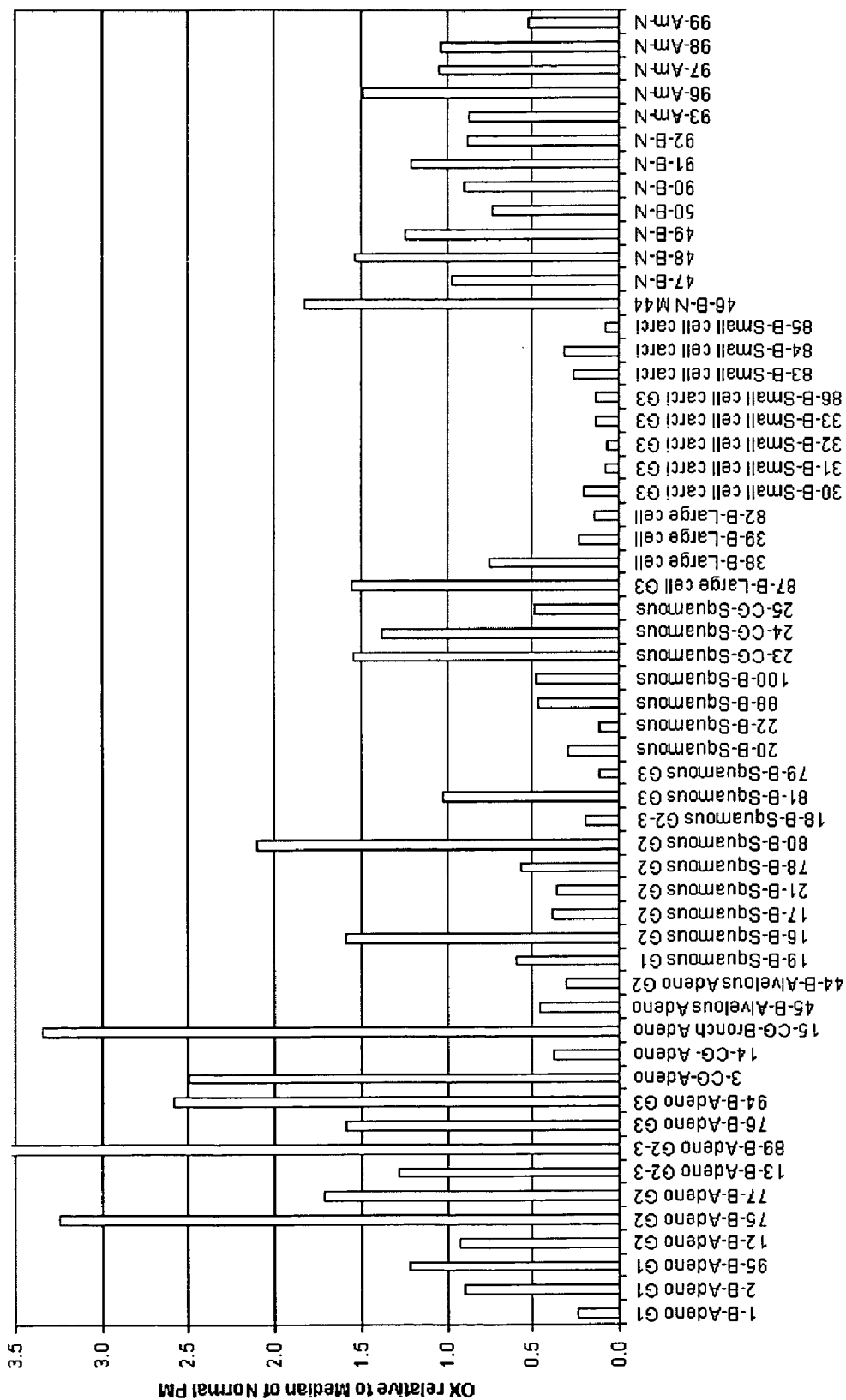
FIGS. 17A and 17B show down regulation of the above-indicated *Homo sapiens* plasminogen activator, urokinase receptor (PLAUR) transcripts (seg22) in small cell Lung samples relative to the normal samples.
Figure 17B:
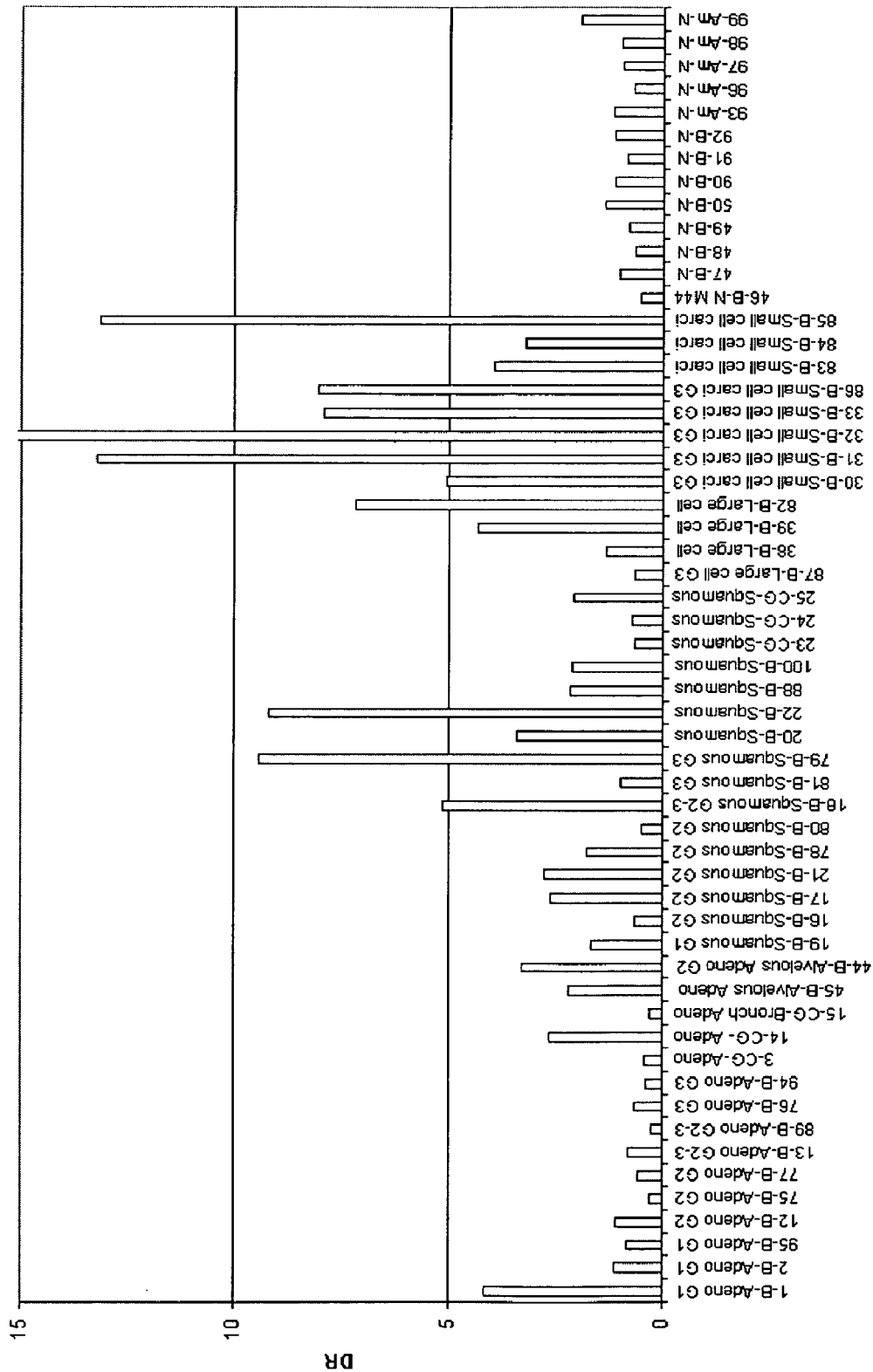

FIGS. 17A and 17B show down regulation of the above-indicated Homo sapiens plasminogen activator, urokinase receptor (PLAUR) transcripts (seg22) in small cell Lung samples relative to the normal samples.

As is evident from FIGS. 17A and 17B, the expression of Homo sapiens plasminogen activator, urokinase receptor (PLAUR) transcripts detectable by the above amplicon in cancer samples was lower than in the small cell carcinoma samples (Sample Nos. 46-50, 90-93, 96-99 Table 2_4). Notably down regulation of at least 5 fold was found in 6 out of 8 small cells carcinoma samples.

Statistical analysis was applied to verify the significance of these results, as described below.

The P value for the difference in the expression levels of Homo sapiens plasminogen activator, urokinase receptor (PLAUR) transcripts detectable by the above amplicon in small cell carcinoma samples versus the normal tissue samples was determined by T test as 2.26E-03.

Threshold of 5 fold down regulation was found to differentiate between small cell carcinomas and normal samples with P value of 7.22E-04 as checked by exact fisher test. The above values demonstrate statistical significance of the results.

Figure 18:
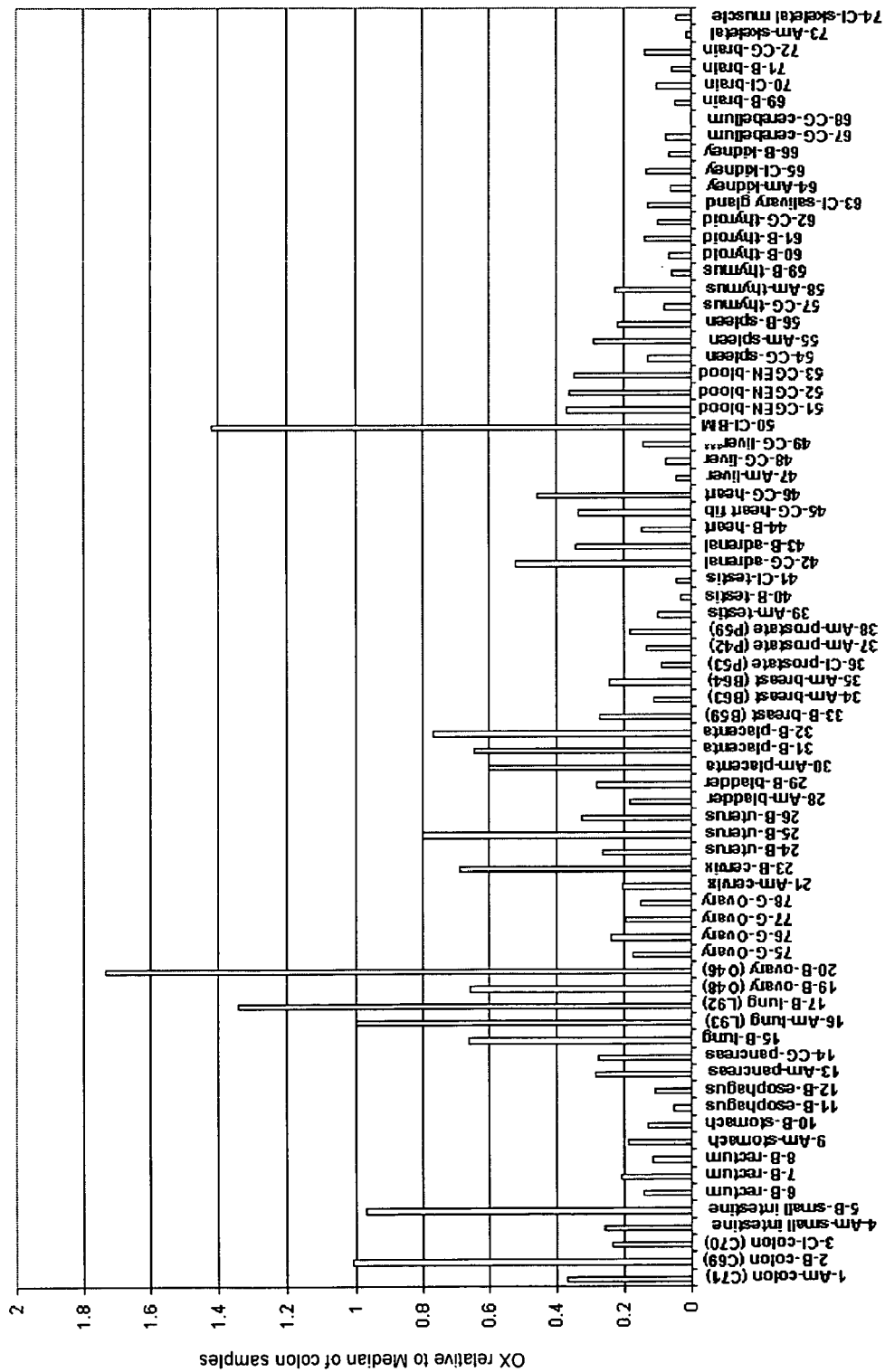
FIG. 18 shows expression of *Homo sapiens* plasminogen activator, urokinase receptor (PLAUR) HSUPARAA transcripts which are detectable by amplicon as depicted in sequence name HSUPARAA_seg22WT (SEQ ID NO:487) in different normal tissues.

Expression of Homo sapiens plasminogen activator, urokinase receptor (PLAUR) HSUPARAA transcripts which are detectable by amplicon as depicted in sequence name HSUPARAA_seg22WT (SEQ ID NO:487) in different normal tissues:

Expression of Homo sapiens plasminogen activator, urokinase receptor (PLAUR) transcripts detectable by or according to seg22WT—HSUPARAA_seg22WT (SEQ ID NO:487) amplicon and primers HSUPARAA_seg22WTF (SEQ ID NO:485) and HSUPARAA_seg22WTR (SEQ ID NO:486) was measured by real time PCR. In parallel the expression of four housekeeping genes—SDHA (GenBank Accession No. NM_004168 (SEQ ID NO:462); amplicon—SDHA-amplicon (SEQ ID NO:465)), Ubiquitin (GenBank Accession No. BC000449 (SEQ ID NO:458); amplicon—Ubiquitin-amplicon (SEQ ID NO:461)), RPL19 (GenBank Accession No. NM_000981 (SEQ ID NO:450); RPL19 amplicon (SEQ ID NO:453)) and TATA box (GenBank Accession No. NM_003194 (SEQ ID NO:454)); TATA amplicon (SEQ ID NO:457)) was measured similarly. For each RT sample, the expression of the above amplicon was normalized to the geometric mean of the quantities of the housekeeping genes. The normalized quantity of each RT sample was then divided by the median of the quantities of the lung samples (sample numbers 15, 16 and 17, Table 2_6 above), to obtain a value of relative expression of each sample relative to median of the colon samples. FIG. 18 shows expression of Homo sapiens plasminogen activator, urokinase receptor (PLAUR) HSUPARAA transcripts which are detectable by amplicon as depicted in sequence name HSUPARAA_seg22WT (SEQ ID NO:487) in different normal tissues.

```
Primers:
Forward Primer (HSUPARAA_seg22WTF) (SEQ ID NO: 485):
CCGGGCTGTCACCTATTCC Reverse Primer (HSUPARAA_seg22WTR) (SEQ ID NO: 486):
GCACTGTTCTTCAGGGCTGC Amplicon (HSUPARAA_seg22WTR (SEQ ID NO: 487):
CCGGGCTGTCACCTATTCCCGAAGCCGTTACCTCGAATGCATTTCCTGTGGCTCATCA

GACATGAGCTGTGAGAGGGGCCGGCACCAGAGCCTGCAGTGCCGCAGCCCTGAAGAA

CAGTGC
```

Expression of *Homo sapiens* plasminogen activator, urokinase receptor (PLAUR) HSUPARAA transcripts which are detectable by amplicon as depicted in sequence name HSUPARAA seg28-32 (SEQ ID NO:490) in normal and cancerous lung tissues:

Expression of *Homo sapiens* plasminogen activator, urokinase receptor (PLAUR) transcripts detectable by or according to seg28-32, HSUPARAA seg28-32 (SEQ ID NO:490) amplicon and primers HSUPARAA seg28-32F (SEQ ID NO:488) and HSUPARAA seg28-32R (SEQ ID NO:489) was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), Ubiquitin (GenBank Accession No. BC000449 (SEQ ID NO:458)); amplicon—Ubiquitin-amplicon (SEQ ID NO:461)) and SDHA (GenBank Accession No. NM_004168 (SEQ ID NO:462)); amplicon—SDHA-amplicon (SEQ ID NO:465)), was measured similarly. For each RT sample, the expression of the above amplicon was normalized to the geometric mean of the quantities of the housekeeping genes. The normalized quantity of each RT sample was then divided by the median of the quantities of the normal postmortem (PM) samples (Sample Nos. 47-50, 90-93, 96-99, Table 2_4) for which values are presented in FIG. 19A. Then the reciprocal of this ratio was calculated, to obtain a value of fold down-regulation for each sample relative to median of the normal PM samples for which values are presented in FIG. 19B.

Figure 19A:
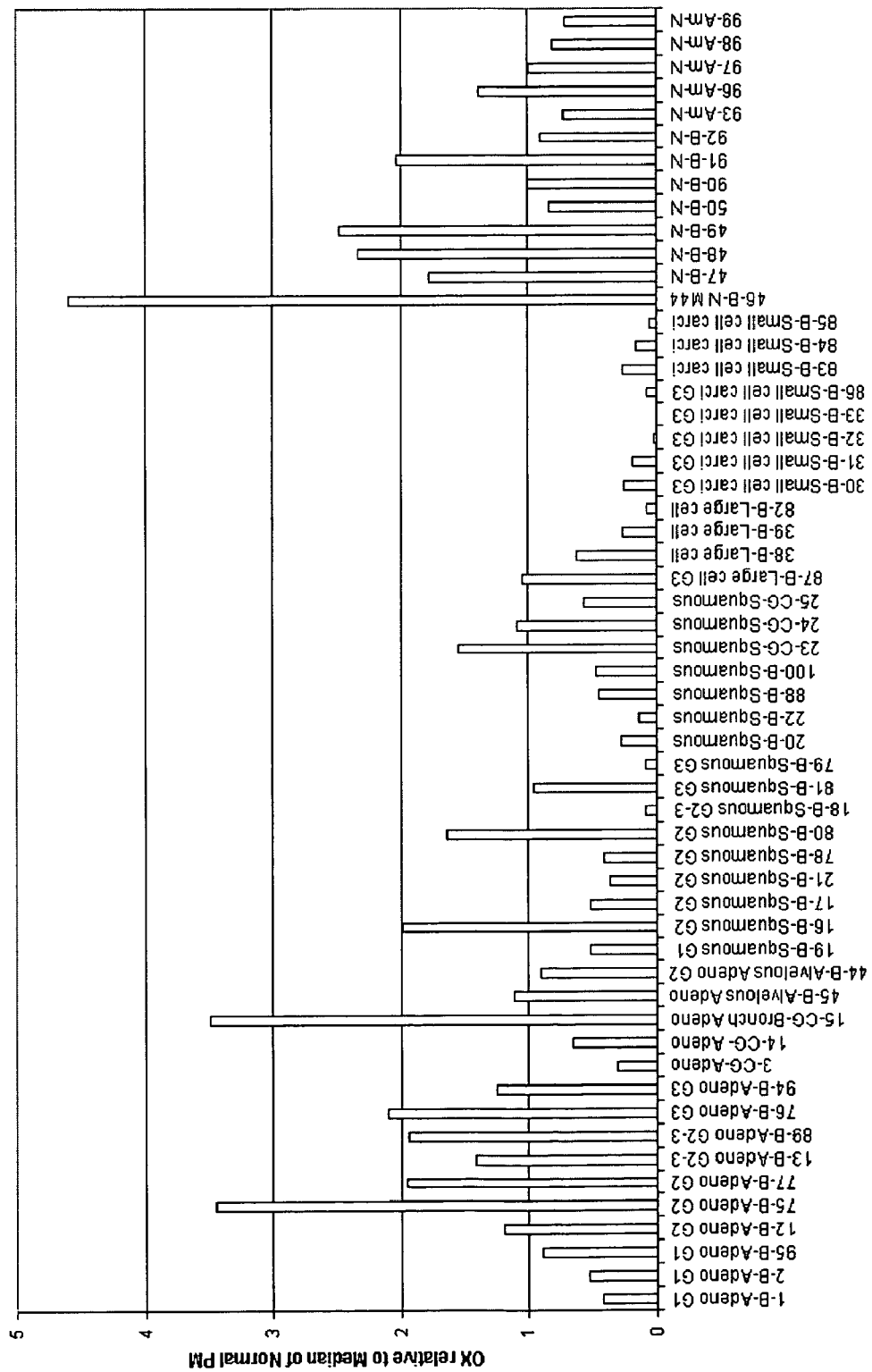
FIGS. 19A and 19B show down regulation of the above-indicated *Homo sapiens* plasminogen activator, urokinase receptor (PLAUR) transcripts in small cell Lung samples relative to the normal samples (seg28-32)
Figure 19B:
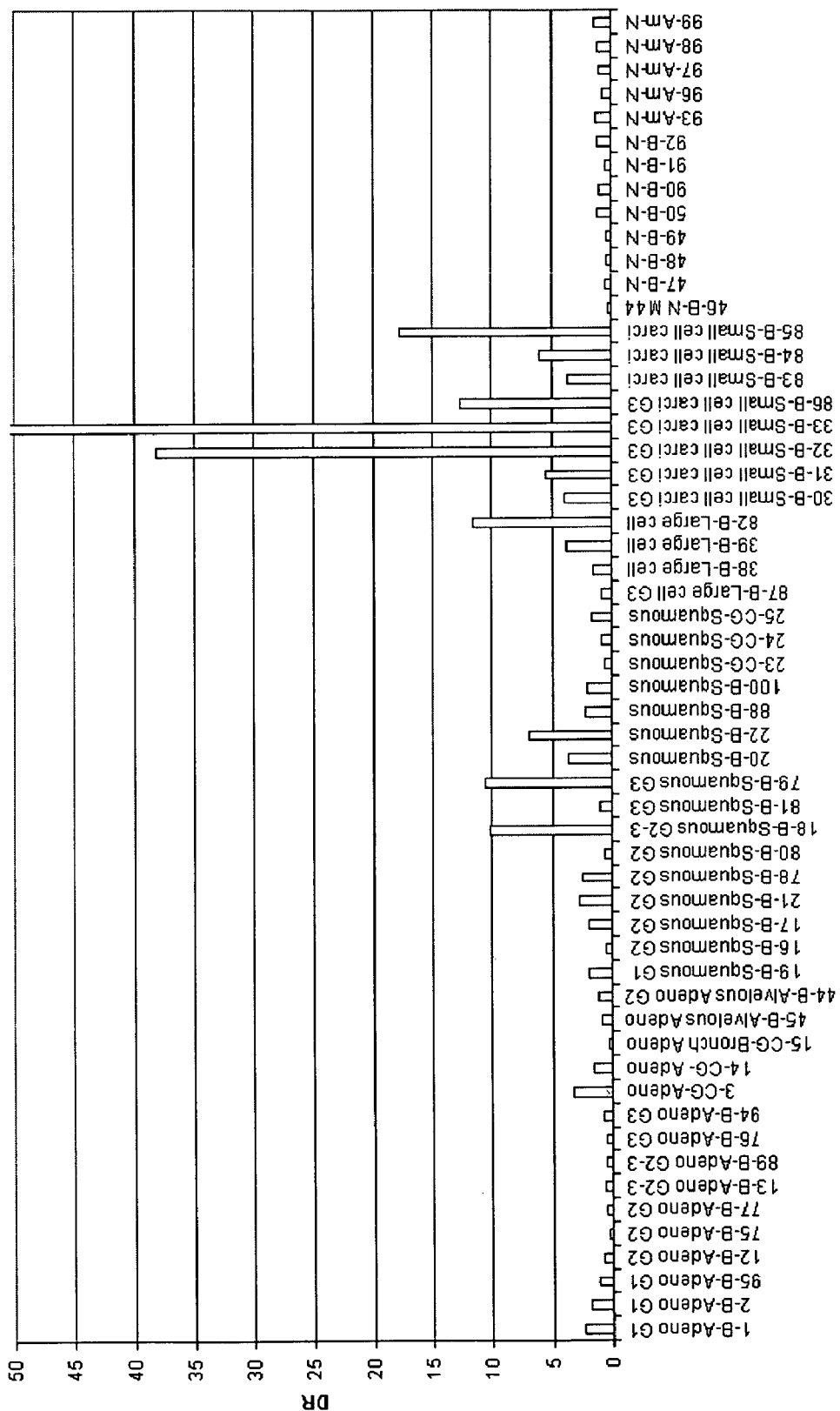

FIGS. 19A and 19B show down regulation of the above-indicated *Homo sapiens* plasminogen activator, urokinase receptor (PLAUR) transcripts in small cell Lung samples relative to the normal samples (seg28-32).

As is evident from FIGS. 19A and 19B, the expression of *Homo sapiens* plasminogen activator, urokinase receptor (PLAUR) transcripts detectable by the above amplicon in cancer samples was lower than in the small cell carcinoma samples (Sample Nos. 46-50, 90-93, 96-99 Table 2_4). Notably down regulation of at least 5 fold was found in 6 out of 8 small cell carcinoma samples.

Statistical analysis was applied to verify the significance of these results, as described below.

Threshold of 5 fold down regulation was found to differentiate between small cell carcinoma and normal samples with P value of 7.22E-04 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: HSUPARAA seg28-32F (SEQ ID NO:488) forward primer; and HSUPARAA seg28-32R (SEQ ID NO:489) reverse primer.

The present invention also preferably encompasses any amplicon obtained through the use of any suitable primer pair; for example, for the above experiment, the following amplicon was obtained as a non-limiting illustrative example only of a suitable amplicon: HSUPARAA seg28-32 (SEQ ID NO:490).

```
Primers:
Forward primer HSUPARAA seg28-32F (SEQ ID NO: 488):
TAAGGAACGGGAGACACAGTCC Reverse primer HSUPARAA seg28-32R (SEQ ID NO: 489):
TCAGAGGAGCATCCATGGGT Amplicon HSUPARAA seg28-32 (SEQ ID NO: 490):
TAAGGAACGGGAGACACAGTCCTGGAGCTTGAAAATCTGCCGCAGAATGGCCGCCAG

TGTTACAGCTGCAAGGGGAACAGCACCCATGGATGCTCCTCTGA
```

Expression of *Homo sapiens* plasminogen activator, urokinase receptor (PLAUR) HSUPARAA transcripts which are detectable by amplicon as depicted in sequence name HSUPARAA_seg28-32 (SEQ ID NO:490) in different normal tissues:

Expression of *Homo sapiens* plasminogen activator, urokinase receptor (PLAUR) transcripts detectable by or according to seg28-32—HSUPARAA_seg28-32 (SEQ ID NO:490) amplicon and primers HSUPARAA_seg28-32F (SEQ ID NO:488) and HSUPARAA_seg28-32R (SEQ ID NO:489) was measured by real time PCR. In parallel the expression of four housekeeping genes—SDHA (GenBank Accession No. NM_004168 (SEQ ID NO:462); amplicon—SDHA-amplicon (SEQ ID NO:465)), Ubiquitin (GenBank Accession No. BC000449 (SEQ ID NO:458); amplicon—Ubiquitin-amplicon (SEQ ID NO:461)), RPL19 (GenBank Accession No. NM_000981 (SEQ ID NO:450); RPL19 amplicon (SEQ ID NO:453)) and TATA box (GenBank Accession No.

Figure 20:
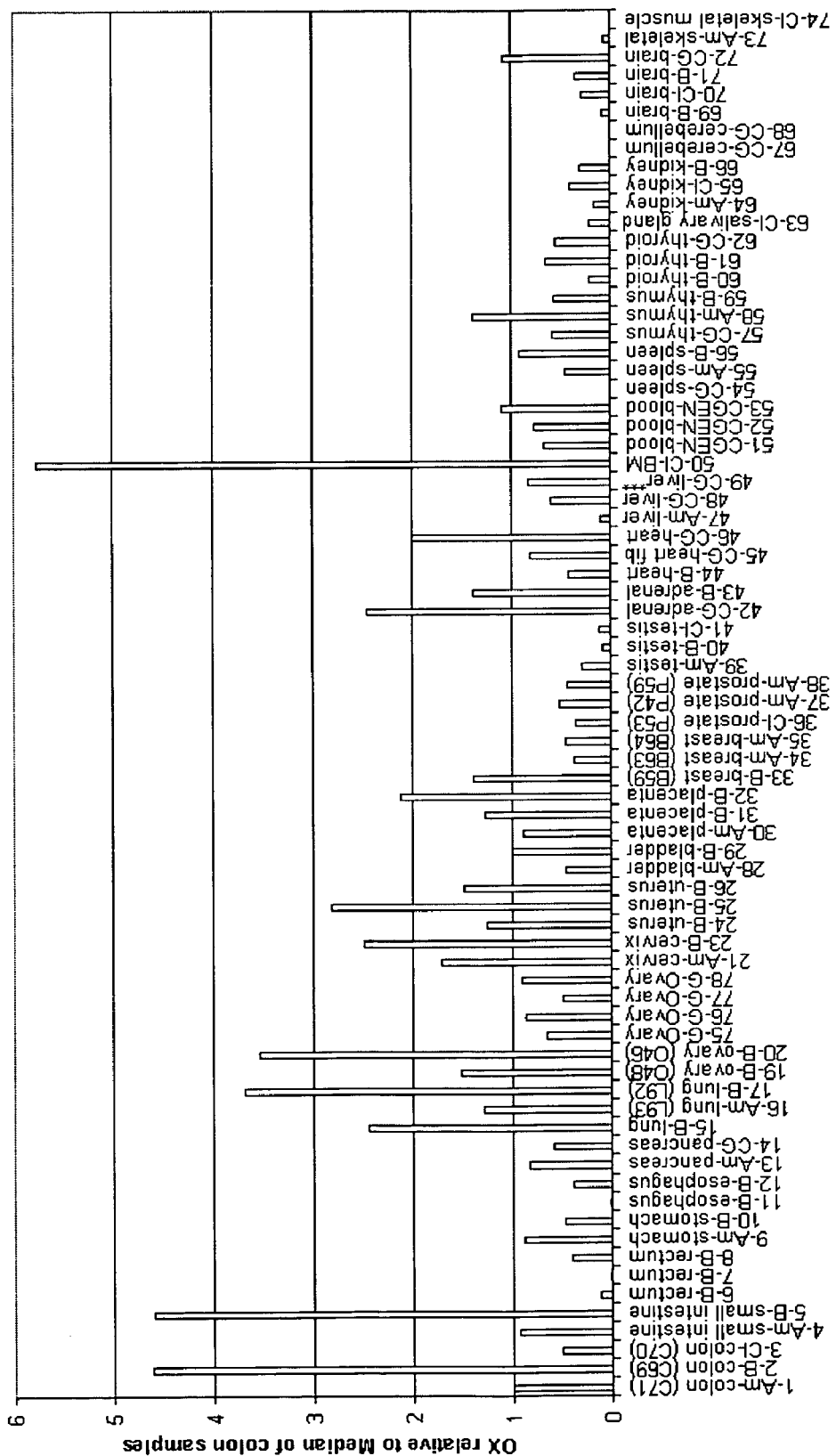
FIG. 20 shows expression of *Homo sapiens* plasminogen activator, urokinase receptor (PLAUR) HSUPARAA transcripts which are detectable by amplicon as depicted in sequence name HSUPARAA_seg28-32 (SEQ ID NO:490)in different normal tissues.

NM_003194 (SEQ ID NO:454); TATA amplicon (SEQ ID NO:457)) was measured similarly. For each RT sample, the expression of the above amplicon was normalized to the geometric mean of the quantities of the housekeeping genes. The normalized quantity of each RT sample was then divided by the median of the quantities of the lung samples (sample numbers 15, 16 and 17, Table 2_6 above), to obtain a value of relative expression of each sample relative to median of the colon samples. FIG. 20 shows expression of *Homo sapiens* plasminogen activator, urokinase receptor (PLAUR) HSUPARAA transcripts which are detectable by amplicon as depicted in sequence name HSUPARAA_seg28-32 (SEQ ID NO:490) in different normal tissues.

Figure 21A:
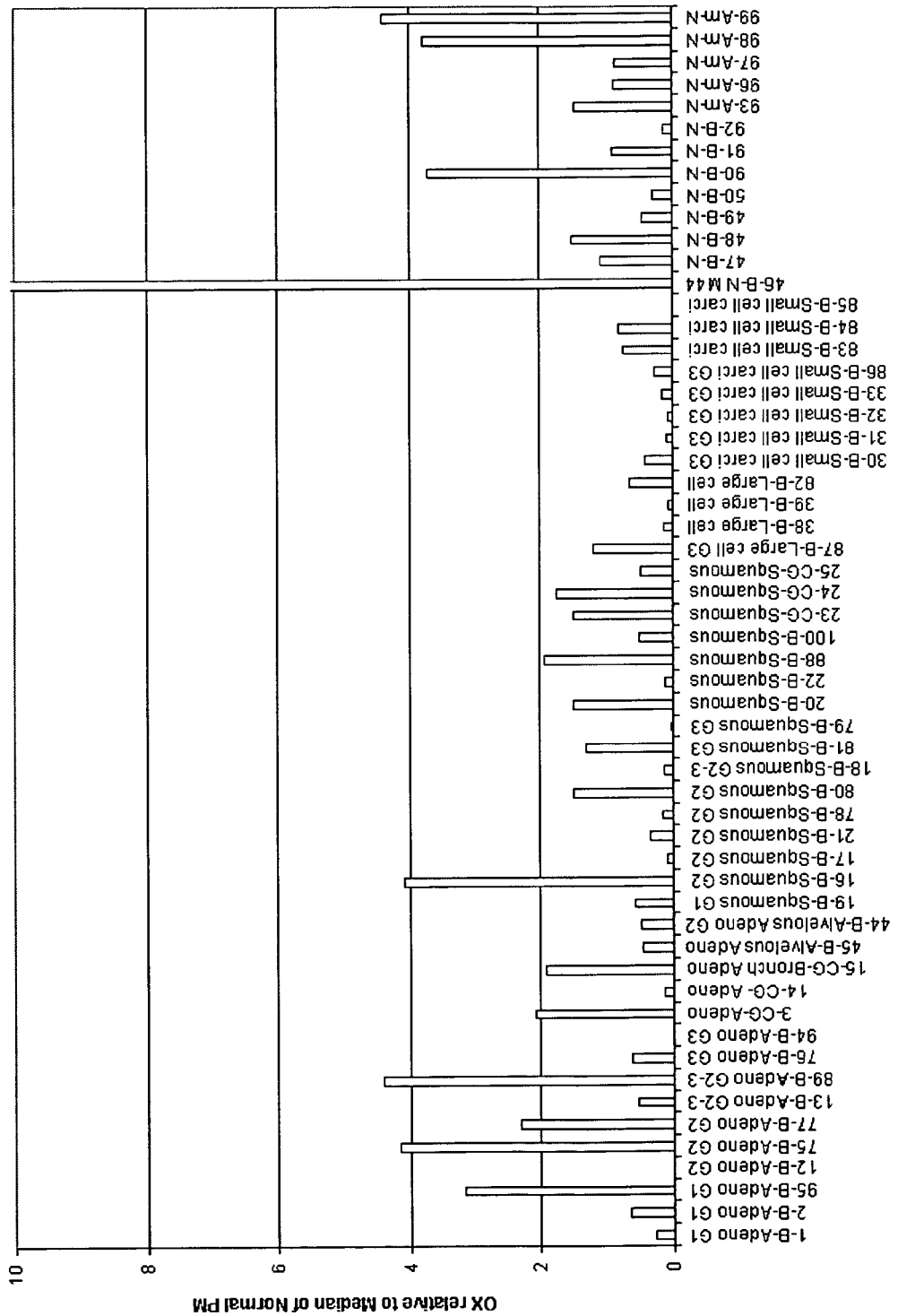
FIGS. 21A and 21B show expression of *Homo sapiens* plasminogen activator, urokinase receptor (PLAUR) HSUPARAA transcripts which are detectable by amplicon as depicted in sequence name HSUPARAA seg19-22 (SEQ ID NO:493) in normal and cancerous Lung tissues.

Table 2_4) for which values are presented in FIG. 21A. Then the reciprocal of this ratio was calculated, to obtain a value of fold down-regulation for each sample relative to median of the normal PM samples for which values are presented in FIG. 21B.

Figure 21B:
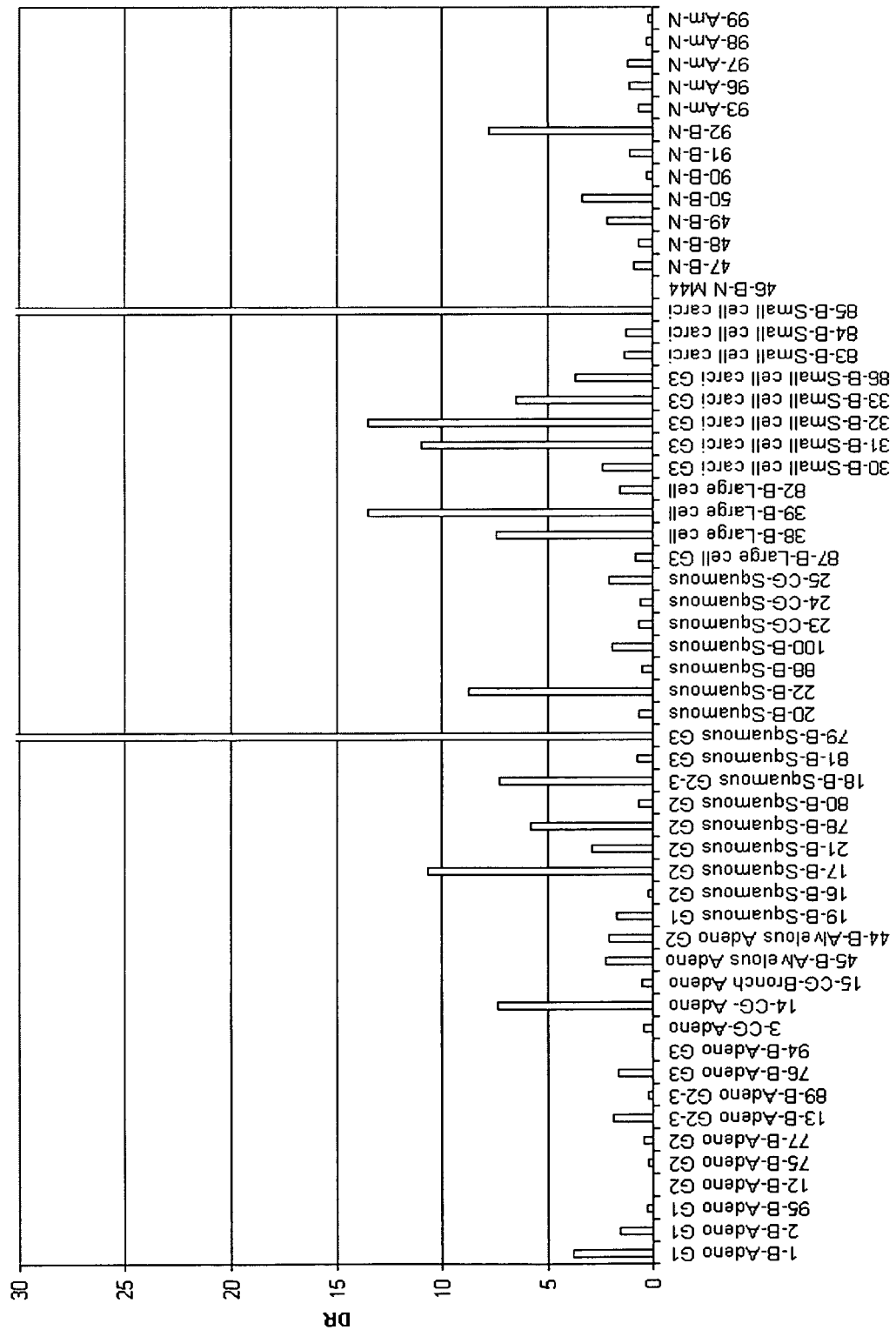

FIGS. 21A and 21B show down regulation of the above-indicated *Homo sapiens* plasminogen activator, urokinase receptor (PLAUR) transcripts in small cell Lung samples relative to the normal samples.

As is evident from FIGS. 21A and 21B, the expression of *Homo sapiens* plasminogen activator, urokinase receptor (PLAUR) transcripts detectable by the above amplicon in cancer samples was lower than in the small cell carcinoma

```
Primers:
Forward Primer (HSUPARAA seg28-32F (SEQ ID NO: 488)):
TAAGGAACGGGAGACACAGTCC Reverse Primer (HSUPARAA seg28-32R (SEQ ID NO: 489)):
TCAGAGGAGCATCCATGGGT Amplicon (HSUPARAA_seg28-32 (SEQ ID NO: 490)):
TAAGGAACGGGAGACACAGTCCTGGAGCTTGAAAATCTGCCGCAGAATGGCCGCCAG

TGTTACAGCTGCAAGGGGAACAGCACCCATGGATGCTCCTCTGA
```

Expression of *Homo sapiens* plasminogen activator, urokinase receptor (PLAUR) HSUPARAA transcripts which are detectable by amplicon as depicted in sequence name HSUPARAA seg19-22 (SEQ ID NO:493) in normal and cancerous Lung tissues:

Expression of *Homo sapiens* plasminogen activator, urokinase receptor (PLAUR) transcripts detectable by or according to seg19-22, HSUPARAA seg19-22 (SEQ ID NO:493) amplicon and primers HSUPARAA seg19-22F (SEQ ID NO:491) and HSUPARAA seg19-22R (SEQ ID NO:492) was measured by real time PCR. In parallel the expression of four housekeeping genes—PBGD (GenBank Accession No. BC019323 (SEQ ID NO:430)); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), Ubiquitin (GenBank Accession No. BC000449 (SEQ ID NO:458); amplicon—Ubiquitin-amplicon (SEQ ID NO:461)) and SDHA (GenBank Accession No. NM_004168 (SEQ ID NO:462); amplicon—SDHA-amplicon (SEQ ID NO:465)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, samples (Sample Nos. 46-50, 90-93, 96-99 Table 2_4). Notably down regulation of at least 5 fold was found in 4 out of 8 small cells carcinoma samples.

Primer pairs are also optionally and preferably encompassed within the present invention; for example, for the above experiment, the following primer pair was used as a non-limiting illustrative example only of a suitable primer pair: HSUPARAA seg19-22F (SEQ ID NO:491) forward primer; and HSUPARAA seg19-22R (SEQ ID NO:492) reverse primer.

The present invention also preferably encompasses any amplicon obtained through the use of any suitable primer pair; for example, for the above experiment, the following amplicon was obtained as a non-limiting illustrative example only of a suitable amplicon: HSUPARAA seg19-22 (SEQ ID NO:493).

```
Primers:
Forward primer HSUPARAA seg19-22F (SEQ ID NO: 491):
GTAACGGATCCAGTTGGCCA Reverse primer HSUPARAA seg19-22R (SEQ ID NO: 492):
TGATGAGCCACAGGAAATGC Amplicon HSUPARAA seg19-22 (SEQ ID NO: 493):
GTAACGGATCCAGTTGGCCAACACCACAAGGTTCGTGCAAAAGGCGAAGTGATCAGG

AATCAGTCAAGCCGGGCTGTCACCTATTCCCGAAGCCGTTACCTCGAATGCATTTCCT

GTGGCTCATCA
```

Figure 22:
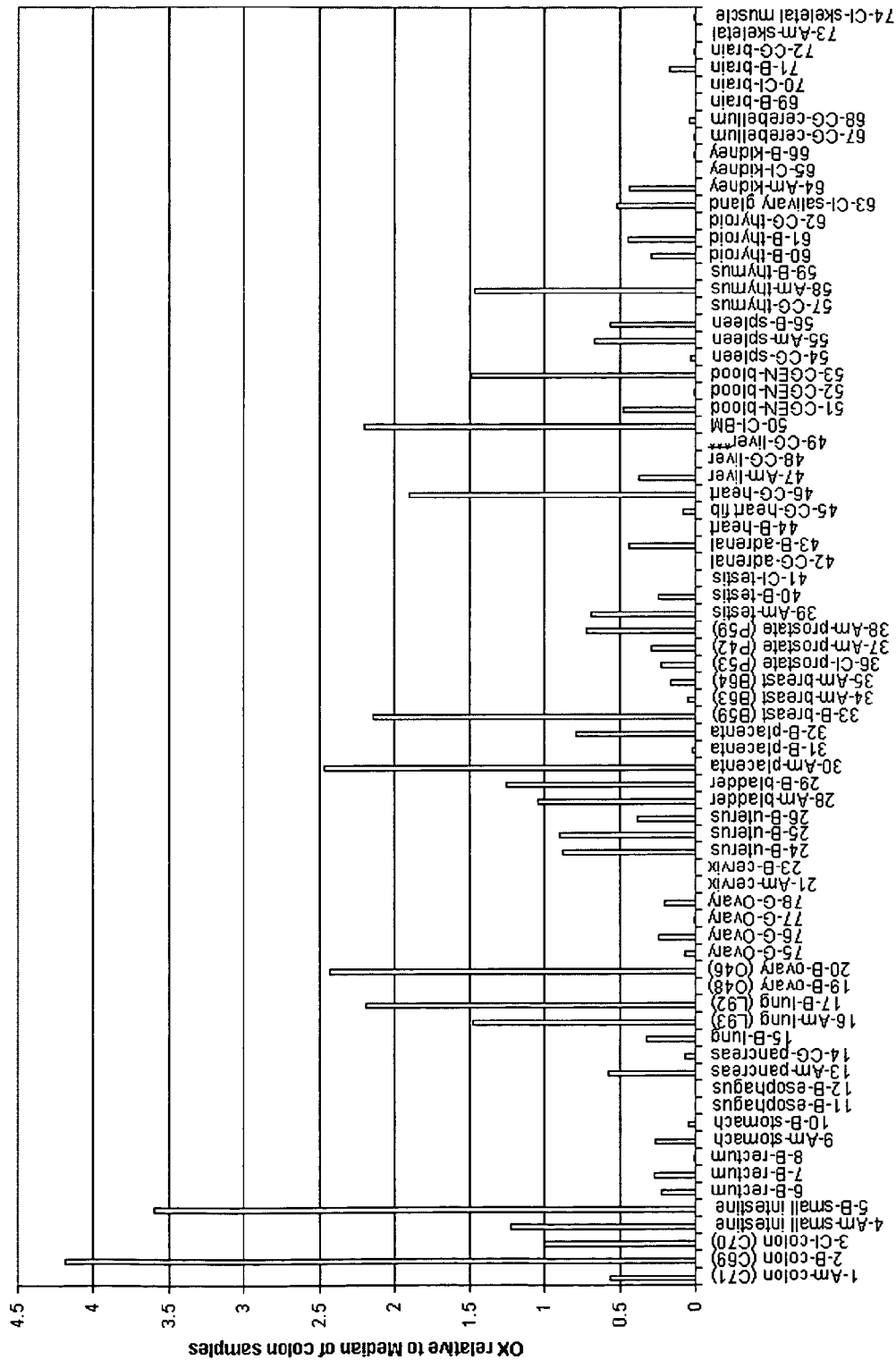
FIG. 22 shows expression of *Homo sapiens* plasminogen activator, urokinase receptor (PLAUR) HSUPARAA transcripts which are detectable by amplicon as depicted in sequence name HSUPARAA_seg19-22 (SEQ ID NO:493) in different normal tissues.

Expression of *Homo sapiens* plasminogen activator, urokinase receptor (PLAUR) HSUPARAA transcripts which are detectable by amplicon as depicted in sequence name HSUPARAA_seg19-22 (SEQ ID NO:493) in different normal tissues:

Expression of *Homo sapiens* plasminogen activator, urokinase receptor (PLAUR) transcripts detectable by or according to seg19-22—HSUPARAA_seg19-22 (SEQ ID NO:493) amplicon and primers HSUPARAA_seg19-22F (SEQ ID NO:491) and HSUPARAA_seg19-22R (SEQ ID NO:492) was measured by real time PCR. In parallel the expression of four housekeeping genes—SDHA (GenBank Accession No. NM_004168 (SEQ ID NO:462)); amplicon—SDHA-amplicon (SEQ ID NO:465)), Ubiquitin (GenBank Accession No. BC000449 (SEQ ID NO:458)); amplicon—Ubiquitin-amplicon (SEQ ID NO:461)), RPL19 (GenBank Accession No. NM_000981 (SEQ ID NO:450)); RPL19 amplicon (SEQ ID NO:453)) and TATA box (GenBank Accession No. NM_003194 (SEQ ID NO:454); TATA amplicon (SEQ ID NO:457) (SEQ ID NO:457)) was measured similarly. For each RT sample, the expression of the above amplicon was normalized to the geometric mean of the quantities of the housekeeping genes. The normalized quantity of each RT sample was then divided by the median of the quantities of the lung samples (sample numbers 15, 16 and 17, Table 2_6 above), to obtain a value of relative expression of each sample relative to median of the colon samples. FIG. 22 shows expression of *Homo sapiens* plasminogen activator, urokinase receptor (PLAUR) HSUPARAA transcripts which are detectable by amplicon as depicted in sequence name HSUPARAA_seg19-22 (SEQ ID NO:493) in different normal tissues.

```
Primers:
Forward primer HSUPARAA seg19-22F (SEQ ID NO: 491):
GTAACGGATCCAGTTGGCCA Reverse primer HSUPARAA seg19-22R (SEQ ID NO: 492):
TGATGAGCCACAGGAAATGC Amplicon HSUPARAA seg19-22 (SEQ ID NO: 493):
GTAACGGATCCAGTTGGCCAACACCACAAGGTTCGTGCAAAAGGCGAAGTGATCAGG

AATCAGTCAAGCCGGGCTGTCACCTATTCCCGAAGCCGTTACCTCGAATGCATTTCCT

GTGGCTCATCA
```

Description for Cluster R11723

Cluster R11723 features 9 transcript(s) and 23 segment(s) of interest, the names for which are given in Tables 290 and 291, respectively, the sequences themselves are given at the end of the application. The selected protein variants are given in table 292.

TABLE 290

Transcripts of interest
Transcript Name

R11723_1_T7 (SEQ ID NO: 238)
R11723_1_T8 (SEQ ID NO: 239)
R11723_1_T9 (SEQ ID NO: 240)
R11723_1_T10 (SEQ ID NO: 241)
R11723_1_T11 (SEQ ID NO: 242)
R11723_1_T12 (SEQ ID NO: 243)
R11723_1_T13 (SEQ ID NO: 244)
R11723_1_T14 (SEQ ID NO: 245)
R11723_1_T15 (SEQ ID NO: 246)

TABLE 291

Segments of interest
Segment Name

R11723_1_N0 (SEQ ID NO: 247)
R11723_1_N2 (SEQ ID NO: 248)
R11723_1_N14 (SEQ ID NO: 249) (also called R11723 seg 13)

TABLE 291-continued

Segments of interest
Segment Name

R11723_1_N17 (SEQ ID NO: 250)
R11723_1_N20 (SEQ ID NO: 251)
R11723_1_N23 (SEQ ID NO: 252)
R11723_1_N25 (SEQ ID NO: 253)
R11723_1_N27 (SEQ ID NO: 254)
R11723_1_N3 (SEQ ID NO: 255)
R11723_1_N4 (SEQ ID NO: 256)
R11723_1_N5 (SEQ ID NO: 257)
R11723_1_N6 (SEQ ID NO: 258)
R11723_1_N7 (SEQ ID NO: 259)
R11723_1_N8 (SEQ ID NO: 260)
R11723_1_N10 (SEQ ID NO: 261)
R11723_1_N11 (SEQ ID NO: 262)
R11723_1_N12 (SEQ ID NO: 263)
R11723_1_N16 (SEQ ID NO: 264)
R11723_1_N19 (SEQ ID NO: 265)
R11723_1_N21 (SEQ ID NO: 266)
R11723_1_N22 (SEQ ID NO: 267)
R11723_1_N24 (SEQ ID NO: 268)
R11723_1_N26 (SEQ ID NO: 269)

TABLE 292

| Proteins of interest | |
|---|---|
| Protein Name | Corresponding Transcript(s) |
| R11723_1_P9 (SEQ ID NO: 276) | R11723_1_T7 (SEQ ID NO: 238) |
| R11723_1_P13 (SEQ ID NO: 277) | R11723_1_T12 (SEQ ID NO: 243); R11723_1_T8 (SEQ ID NO: 239) |
| R11723_1_P14 (SEQ ID NO: 278) | R11723_1_T14 (SEQ ID NO: 245); R11723_1_T9 (SEQ ID NO: 240) |
| R11723_1_P15 (SEQ ID NO: 279) | R11723_1_T13 (SEQ ID NO: 244) |
| R11723_1_P16 (SEQ ID NO: 280) | R11723_1_T15 (SEQ ID NO: 246) |
| R11723_1_P19 (SEQ ID NO: 281) | R11723_1_T10 (SEQ ID NO: 241); R11723_1_T11 (SEQ ID NO: 242); R11723_1_T12 (SEQ ID NO: 243); R11723_1_T8 (SEQ ID NO: 239); R11723_1_T9 (SEQ ID NO: 240) |
| R11723_1_P11 (SEQ ID NO: 641) | R11723_1_T10 |
| R11723_1_P12 (SEQ ID NO: 642) | R11723_1_T11 |

These sequences are variants of the known protein LY6/PLAUR domain containing 1 (SEQ ID NO:270) (SwissProt accession identifier NP_653187), referred to herein as the previously known protein.

The sequence for protein LY6/PLAUR domain containing 1 (SEQ ID NO:270) is given at the end of the application, as "LY6/PLAUR domain containing 1 (SEQ ID NO:270) amino acid sequence".

Cluster R11723 can be used as a diagnostic marker according to overexpression of transcripts of this cluster in cancer. Expression of such transcripts in normal tissues is also given according to the previously described methods. The term "number" in the left hand column of the table and the numbers on the y-axis of the figure below refer to weighted expression of ESTs in each category, as "parts per million" (ratio of the expression of ESTs for a particular cluster to the expression of all ESTs in that category, according to parts per million).

Figure 23:
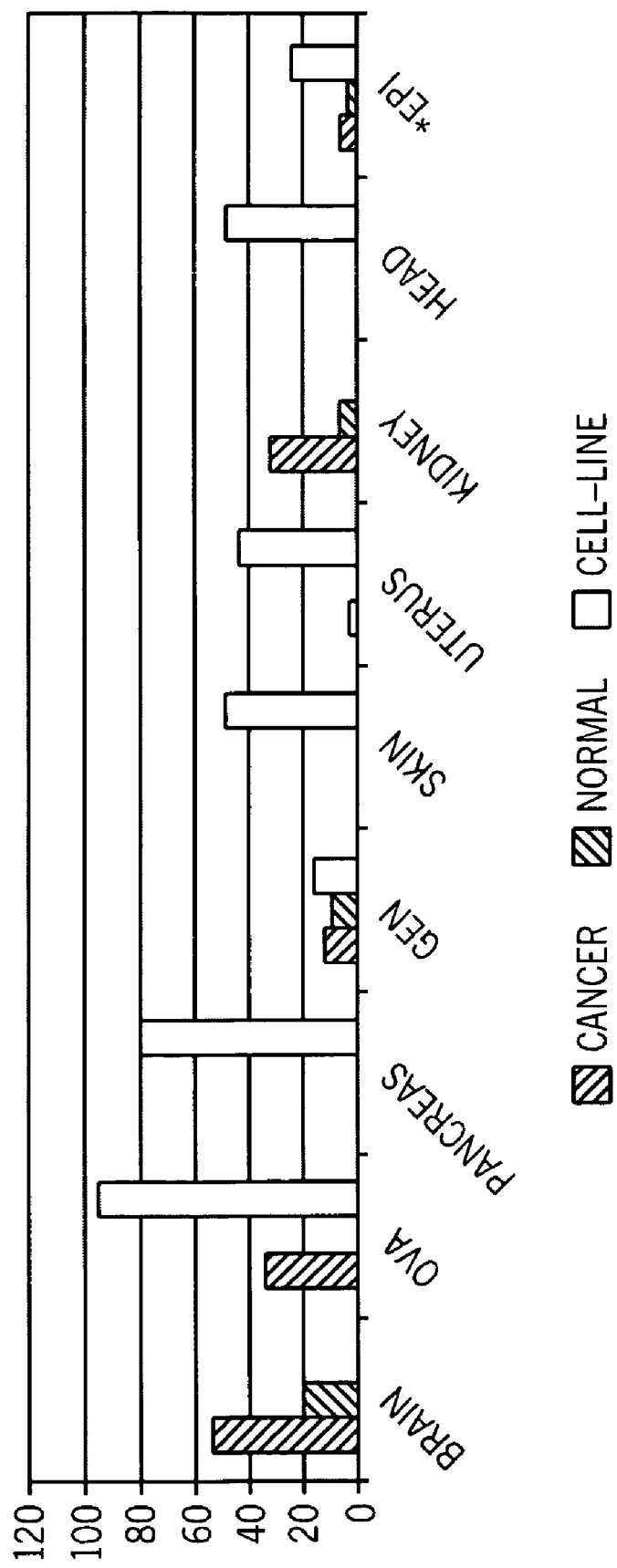
FIG. 23 is a histogram showing Cancer and cell-line vs. normal tissue expression for Cluster R11723, demonstrating overexpression in epithelial malignant tumors.

Overall, the following results were obtained as shown with regard to the histograms in FIG. 23 and Table 293. This cluster is overexpressed (at least at a minimum level) in the following pathological conditions: epithelial malignant tumors.

TABLE 293

Normal tissue distribution

| Name of Tissue | Number |
|---|---|
| brain | 21 |
| ovary | 0 |
| pancreas | 0 |
| general | 8 |
| skin | 0 |
| uterus | 0 |
| kidney | 6 |
| head and neck | 0 |
| epithelial | 2 |

TABLE 294

P values and ratios for expression in cancerous tissue

| Name of Tissue | P1 | P2 | SP1 | R3 | SP2 | R4 |
|---|---|---|---|---|---|---|
| brain | 7.2e−01 | 8.4e−01 | 8.5e−02 | 1.9 | 4.7e−01 | 0.9 |
| ovary | 4.0e−01 | 2.8e−01 | 4.7e−01 | 1.9 | 2.7e−01 | 2.2 |
| pancreas | N/A | 1.6e−01 | N/A | N/A | 1.5e−01 | 3.7 |
| general | 7.8e−01 | 8.0e−01 | 2.7e−01 | 1.3 | 4.7e−02 | 1.4 |
| skin | N/A | 5.0e−01 | N/A | N/A | 7.1e−02 | 2.1 |
| uterus | 4.7e−01 | 3.9e−01 | N/A | N/A | 4.1e−01 | 1.5 |
| kidney | 7.6e−01 | 8.4e−01 | 3.3e−01 | 1.9 | 4.8e−01 | 1.4 |
| head and neck | N/A | 5.0e−01 | N/A | N/A | 7.5e−01 | 1.3 |
| epithelial | 1.8e−01 | 6.2e−02 | 2.3e−01 | 2.2 | 3.6e−03 | 3.8 |

As noted above, cluster R11723 features 9 transcript(s), which were listed in Table 290 above. These transcript(s) encode for protein(s) which are variant(s) of protein LY6/PLAUR domain containing 1 (SEQ ID NO:270). A description of each variant protein according to the present invention is now provided.

Variant protein R11723_1_P9 (SEQ ID NO:276) according to the present invention has an amino acid sequence as given at the end of the application; it is encoded by transcript(s) R11723_1_T7 (SEQ ID NO:238). An alignment is given to the known protein (LY6/PLAUR domain containing 1 (SEQ ID NO:270)) at the end of the application. One or more alignments to one or more previously published protein sequences are given at the end of the application. A brief description of the relationship of the variant protein according to the present invention to each such aligned protein is as follows:

1. Comparison Report Between R11723_1_P9 (SEQ ID NO:276) and Q8IXM0_HUMAN (SEQ ID NO:272):

A. An isolated chimeric polypeptide encoding for R11723_1_P9 (SEQ ID NO:276), comprising a first amino acid sequence being at least 70%, optionally at least 80%, preferably at least 85%, more preferably at least 90% and most preferably at least 95%, homologous to a polypeptide having the sequence MWVLGIAATFCGLFLLPGFALQIQ-CYQCEEFQLNNDCSSPEFIVNCTVNVQD-MCQKEVME QSAGIMYRKSCASSAACLIASAGSPCR-GLAPGREEQRALHKAGAVGGGVR (SEQ ID NO:605) corresponding to amino acids 1-110 of R11723_1_P9 (SEQ ID NO:276), and a second amino acid sequence being at least 90% homologous to MYAQALLVVGVLQRQAAAQHL-HEHPPKLLRGHRVQERVDDRAEVEKRL-REGEEDHVRP EVGPRPVVLGFGRSHDPPNLVGH-PAYGQCHNNQPWADTSRRERQRKEKHSMRTQ corresponding to amino acids 1-112 of Q8IXM0_HUMAN (SEQ ID NO:272), which also corresponds to amino acids 111-222 of R11723_1_P9 (SEQ ID NO:276), wherein said first amino acid sequence and second amino acid sequence are contiguous and in a sequential order.

B. An isolated polypeptide encoding for a head of R11723_1_P9 (SEQ ID NO:276), comprising a polypeptide being at least 70%, optionally at least about 80%, preferably at least about 85%, more preferably at least about 90% and most preferably at least about 95% homologous to the sequence MWVLGIAATFCGLFLLPGFALQIQCYQ-CEEFQLNNDCSSPEFIVNCTVNVQDMCQKEVME QSAGIMYRKSCASSAACLIASAGSPCR-GLAPGREEQRALHKAGAVGGGVR (SEQ ID NO:605) of R11723_1_P9 (SEQ ID NO:276).

2. Comparison report between R11723_1_P9 (SEQ ID NO:276) and Q96AC2_HUMAN (SEQ ID NO:275):

A. An isolated chimeric polypeptide encoding for R11723_1_P9 (SEQ ID NO:276), comprising a first amino acid sequence being at least 90% homologous to MWVL-GIAATFCGLFLLPGFALQIQCYQ-CEEFQLNNDCSSPEFIVNCTVNVQDMCQKEVME QSAGIMYRKSCASSAACLIASAG corresponding to amino acids 1-83 of Q96AC2_HUMAN (SEQ ID NO:275), which also corresponds to amino acids 1-83 of R11723_1_P9 (SEQ ID NO:276), and a second amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) corresponding to amino acids 84-222 of R11723_1_P9 (SEQ ID NO:276), wherein said first amino acid sequence and second amino acid sequence are contiguous and in a sequential order.

B. An isolated polypeptide encoding for an edge portion of R11723_1_P9 (SEQ ID NO:276), comprising an amino acid sequence being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) of R11723_1_P9 (SEQ ID NO:276).

3. Comparison Report Between R11723_1_P9 (SEQ ID NO:276) and Q6ZWI4_HUMAN (SEQ ID NO:271):

A. An isolated chimeric polypeptide encoding for R11723_1_P9 (SEQ ID NO:276), comprising a first amino acid sequence being at least 90% homologous to MWVL-GIAATFCGLFLLPGFALQIQCYQ-CEEFQLNNDCSSPEFIVNCTVNVQDMCQKEVME QSAGIMYRKSCASSAACLIASAG corresponding to amino acids 24-106 of Q6ZWI4_HUMAN (SEQ ID NO:271), which also corresponds to amino acids 1-83 of R11723_1_P9 (SEQ ID NO:276), and a second amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) corresponding to amino acids 84-222 of R11723_1_P9 (SEQ ID NO:276), wherein said, first amino acid sequence and second amino acid sequence are contiguous and in a sequential order.

C. An isolated polypeptide encoding for an edge portion of R11723_1_P9 (SEQ ID NO:276), comprising an amino acid sequence being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) of R11723_1_P9 (SEQ ID NO:276).

4. Comparison Report Between R11723_1_P9 (SEQ ID NO:276) and NP_653187:

A. An isolated chimeric polypeptide encoding for R11723_1_P9 (SEQ ID NO:276), comprising a first amino acid sequence being at least 90% homologous to MWVL-GIAATFCGLFLLPGFALQIQCYQ-CEEFQLNNDCSSPEFIVNCTVNVQDMCQKEVME QSAGIMYRKSCASSAACLIASAG corresponding to amino acids 1-83 of NP_653187, which also corresponds to amino acids 1-83 of R11723_1_P9 (SEQ ID NO:276), and a second amino acid sequence being at least 70%, optionally at least 80%, preferably at least 85%, more preferably at least 90% and most preferably at least 95% homologous to a polypeptide having the sequence SPCRGLAPGREEQRAL-HKAGAVGGGVRMYAQALLVVGV-LQRQAAAQHLHEHPPKLLRG HRVQERVDDRAEVE-KRLREGEEDHVRPEVGPRPVVLGFGRSH-DPPNLVGHPAYGQCHN NQPWADTSRRERQRKEKH-SMRTQ (SEQ ID NO:606) corresponding to amino acids 84-222 of R11723_1_P9 (SEQ ID NO:276), wherein said first amino acid sequence and second amino acid sequence are contiguous and in a sequential order.

B. An isolated polypeptide encoding for an edge portion of R11723_1_P9 (SEQ ID NO:276), comprising an amino acid sequence being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) of R11723_1_P9 (SEQ ID NO:276).

5. Comparison Report Between R11723_1_P9 (SEQ ID NO:276) and Q8N2G4_HUMAN (SEQ ID NO:274):

A. An isolated chimeric polypeptide encoding for R11723_1_P9 (SEQ ID NO:276), comprising a first amino acid sequence being at least 90% homologous to MWVL-GIAATFCGLFLLPGFALQIQCYQ-CEEFQLNNDCSSPEFIVNCTVNVQDMCQKEVME QSAGIMYRKSCASSAACLIASAG corresponding to amino acids 1-83 of Q8N2G4_HUMAN (SEQ ID NO:274), which also corresponds to amino acids 1-83 of R11723_1_P9 (SEQ ID NO:276), and a second amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) corresponding to amino acids 84-222 of R11723_1_P9 (SEQ ID NO:276), wherein said first amino acid sequence and second amino acid sequence are contiguous and in a sequential order.

B. An isolated polypeptide encoding for an edge portion of R11723_1_P9 (SEQ ID NO:276), comprising an amino acid sequence being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) of R11723_1_P9 (SEQ ID NO:276).

6. Comparison Report Between R11723_1_P9 (SEQ ID NO:276) and Q6ZP52_HUMAN (SEQ ID NO:273):

A. An isolated chimeric polypeptide encoding for R11723_1_P9 (SEQ ID NO:276), comprising a first amino acid sequence being at least 70%, optionally at least 80%, preferably at least 85%, more preferably at least 90% and most preferably at least 95%, homologous to a polypeptide having the sequence MWVLG (SEQ ID NO:607) corresponding to amino acids 1-5 of R11723_1_P9 (SEQ ID NO:276), a second amino acid sequence being at least 90% homologous to IAATFCGLFLLPGFALQIQCYQ-CEEFQLNNDCSSPEFIVNCTVNVQDMC-QKEVMEQSAGI MYRKSCASSAACLIASAG corresponding to amino acids 22-99 of Q6ZP52_HUMAN (SEQ ID NO:273), which also corresponds to amino acids 6-83 of R11723_1_P9 (SEQ ID NO:276), and a third amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) corresponding to amino acids 84-222 of R11723_1_P9 (SEQ ID NO:276), wherein said first amino acid sequence, second amino acid sequence and third amino acid sequence are contiguous and in a sequential order.

B. An isolated polypeptide encoding for a head of R11723_1_P9 (SEQ ID NO:276), comprising a polypeptide being at least 70%, optionally at least about 80%, preferably at least about 85%, more preferably at least about 90% and most preferably at least about 95% homologous to the sequence MWVLG (SEQ ID NO:607) of R11723_1_P9 (SEQ ID NO:276).

C. An isolated polypeptide encoding for an edge portion of R11723_1_P9 (SEQ ID NO:276), comprising an amino acid sequence being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHL-HEHPPKLLRG HRVQERVDDRAEVEKRLREGEEDH-VRPEVGPRPVVLGFGRSHDPPNLVGHPAYGQCHN NQPWADTSRRERQRKEKHSMRTQ (SEQ ID NO:606) of R11723_1_P9 (SEQ ID NO:276).

The localization of the variant protein was determined according to results from a number of different software programs and analyses, including analyses from SignalP and other specialized programs. The variant protein is believed to be located as follows with regard to the cell: secreted.

Variant protein R11723_1_P9 (SEQ ID NO:276) also has the following non-silent SNPs (Single Nucleotide Polymorphisms) as listed in Table 295, (given according to their position(s) on the amino acid sequence, with the alternative amino acid(s) listed; the last column indicates whether the SNP is known or not; the presence of known SNPs in variant protein R11723_1_P9 (SEQ ID NO:276) sequence provides support for the deduced sequence of this variant protein according to the present invention).

TABLE 295

Amino acid mutations

| SNP position(s) on amino acid sequence | Alternative amino acid(s) | Previously known SNP? |
|---|---|---|
| 217 | H -> P | Yes |

Variant protein R11723_1_P9 (SEQ ID NO:276) is encoded by the following transcript(s): R11723_1_T7 (SEQ ID NO:238), for which the sequence(s) is/are given at the end of the application. The coding portion of transcript R11723_1_T7 (SEQ ID NO:238) is shown in bold; this coding portion starts at position 430 and ends at position 1095. The transcript also has the following SNPs as listed in Table 296 (given according to their position on the nucleotide sequence, with the alternative nucleic acid listed; the last column indicates whether the SNP is known or not; the presence of known SNPs in variant protein R11723_1_P9 (SEQ ID NO:276) sequence provides support for the deduced sequence of this variant protein according to the present invention).

TABLE 296

Nucleic acid SNPs

| SNP position(s) on nucleotide sequence | Alternative nucleic acid(s) | Previously known SNP? |
|---|---|---|
| 238 | G -> | Yes |
| 723 | G -> A | Yes |
| 1079 | A -> C | Yes |
| 1101 | A -> G | Yes |

Variant protein R11723_1_P13 (SEQ ID NO:277) according to the present invention has an amino acid sequence as given at the end of the application; it is encoded by transcript(s) R11723_1_T12 (SEQ ID NO:243) and R11723_1_T8 (SEQ ID NO:239). An alignment is given to the known protein (LY6/PLAUR domain containing 1 (SEQ ID NO:270)) at the end of the application. One or more alignments to one or more previously published protein sequences are given at the end of the application. A brief description of the relationship of the variant protein according to the present invention to each such aligned protein is as follows:

1. Comparison Report Between R11723_1_P13 (SEQ ID NO:277) and Q96AC2_HUMAN (SEQ ID NO:275):

A. An isolated chimeric polypeptide encoding for R11723_1_P13 (SEQ ID NO:277), comprising a first amino acid sequence being at least 90% homologous to MWVL-GIAATFCGLFLLPG corresponding to amino acids 1-18 of Q96AC2_HUMAN (SEQ ID NO:275), which also corresponds to amino acids 1-18 of R11723_1_P13 (SEQ ID NO:277), and a second amino acid sequence being at least 70%, optionally at least 80%, preferably at least 85%, more preferably at least 90% and most preferably at least 95% homologous to a polypeptide having the sequence ENTQR-PAAEARLCAANPVLPV (SEQ ID NO:608) corresponding to amino acids 19-39 of R11723_1_P13 (SEQ ID NO:277), wherein said first amino acid sequence and second amino acid sequence are contiguous and in a sequential order.

B. An isolated polypeptide encoding for an edge portion of R11723_1_P13 (SEQ ID NO:277), comprising an amino acid sequence being at least 70%, optionally at least about 80%, preferably at least about 85%, more preferably at least about 90% and most preferably at least about 95% homologous to the sequence ENTQRPAAEARLCAANPVLPV (SEQ ID NO:608) of R11723_1_P13 (SEQ ID NO:277).

2. Comparison Report Between R11723_1_P13 (SEQ ID NO:277) and Q6ZWI4_HUMAN (SEQ ID NO:271):

A. An isolated chimeric polypeptide encoding for R11723_1_P13 (SEQ ID NO:277), comprising a first amino acid sequence being at least 90% homologous to MWVL-GIAATFCGLFLLPG corresponding to amino acids 24-41 of Q6ZWI4_HUMAN (SEQ ID NO:271), which also corresponds to amino acids 1-18 of R11723_1_P13 (SEQ ID NO:277), and a second amino acid sequence being at least 70%, optionally at least 80%, preferably at least 85%, more preferably at least 90% and most preferably at least 95% homologous to a polypeptide having the sequence ENTQR-PAAEARLCAANPVLPV (SEQ ID NO:608) corresponding to amino acids 19-39 of R11723_1_P13 (SEQ ID NO:277), wherein said, first amino acid sequence and second amino acid sequence are contiguous and in a sequential order.

C. An isolated polypeptide encoding for an edge portion of R11723_1_P13 (SEQ ID NO:277), comprising an amino acid sequence being at least 70%, optionally at least about 80%, preferably at least about 85%, more preferably at least about 90% and most preferably at least about 95% homologous to the sequence ENTQRPAAEARLCAANPVLPV (SEQ ID NO:608) of R11723_1_P13 (SEQ ID NO:277).

3. Comparison Report Between R11723_1_P13 (SEQ ID NO:277) and NP_653187:

A. An isolated chimeric polypeptide encoding for R11723_1_P13 (SEQ ID NO:277), comprising a first amino acid sequence being at least 90% homologous to MWVL-GIAATFCGLFLLPG corresponding to amino acids 1-18 of NP_653187, which also corresponds to amino acids 1-18 of R11723_1_P13 (SEQ ID NO:277), and a second amino acid sequence being at least 70%, optionally at least 80%, preferably at least 85%, more preferably at least 90% and most preferably at least 95% homologous to a polypeptide having the sequence ENTQRPAAEARLCAANPVLPV (SEQ ID NO:608) corresponding to amino acids 19-39 of R11723_1_P13 (SEQ ID NO:277), wherein said first amino acid sequence and second amino acid sequence are contiguous and in a sequential order.

B. An isolated polypeptide encoding for an edge portion of R11723_1_P13 (SEQ ID NO:277), comprising an amino acid sequence being at least 70%, optionally at least about 80%, preferably at least about 85%, more preferably at least about 90% and most preferably at least about 95% homologous to the sequence ENTQRPAAEARLCAANPVLPV (SEQ ID NO:608) of R11723_1_P13 (SEQ ID NO:277).

4. Comparison Report Between R11723_1_P13 (SEQ ID NO:277) and Q8N2G4_HUMAN (SEQ ID NO:274):

A. An isolated chimeric polypeptide encoding for R11723_1_P13 (SEQ ID NO:277), comprising a first amino acid sequence being at least 90% homologous to MWVLGIAATFCGLFLLPG corresponding to amino acids 1-18 of Q8N2G4_HUMAN (SEQ ID NO:274), which also corresponds to amino acids 1-18 of R11723_1_P13 (SEQ ID NO:277), and a second amino acid sequence being at least 70%, optionally at least 80%, preferably at least 85%, more preferably at least 90% and most preferably at least 95% homologous to a polypeptide having the sequence ENTQRPAAEARLCAANPVLPV (SEQ ID NO:608) corresponding to amino acids 19-39 of R11723_1_P13 (SEQ ID NO:277), wherein said first amino acid sequence and second amnino acid sequence are contiguous and in a sequential order.

B. An isolated polypeptide encoding for an edge portion of R11723_1_P13 (SEQ ID NO:277), comprising an amino acid sequence being at least 70%, optionally at least about 80%, preferably at least about 85%, more preferably at least about 90% and most preferably at least about 95% homologous to the sequence ENTQRPAAEARLCAANPVLPV (SEQ ID NO:608) of R11723_1_P13 (SEQ ID NO:277).

5. Comparison Report Between R11723_1_P13 (SEQ ID NO:277) and Q6ZP52_HUMAN (SEQ ID NO:273):

A. An isolated chimeric polypeptide encoding for R11723_1_P13 (SEQ ID NO:277), comprising a first amino acid sequence being at least 70%, optionally at least 80%, preferably at least 85%, more preferably at least 90% and most preferably at least 95%, homologous to a polypeptide having the sequence MWVLG (SEQ ID NO:607) corresponding to amino acids 1-5 of R11723_1_P13 (SEQ ID NO:277), a second amino acid sequence being at least 90% homologous to IAATFCGLFLLPG corresponding to amino acids 22-34 of Q6ZP52_HUMAN (SEQ ID NO:273), which also corresponds to amino acids 6-18 of R11723_1_P13 (SEQ ID NO:277), and a third amino acid sequence being at least 70%, optionally at least 80%, preferably at least 85%, more preferably at least 90% and most preferably at least 95% homologous to a polypeptide having the sequence ENTQRPAAEARLCAANPVLPV (SEQ ID NO:608) corresponding to amino acids 19-39 of R11723_1_P13 (SEQ ID NO:277), wherein said first amino acid sequence, second amino acid sequence and third amino acid sequence are contiguous and in a sequential order.

B. An isolated polypeptide encoding for a head of R11723_1_P13 (SEQ ID NO:277), comprising a polypeptide being at least 70%, optionally at least about 80%, preferably at least about 85%, more preferably at least about 90% and most preferably at least about 95% homologous to the sequence MWVLG (SEQ ID NO:607) of R11723_1_P13 (SEQ ID NO:277).

C. An isolated polypeptide encoding for an edge portion of R11723_1_P13 (SEQ ID NO:277), comprising an amino acid sequence being at least 70%, optionally at least about 80%, preferably at least about 85%, more preferably at least about 90% and most preferably at least about 95% homologous to the sequence ENTQRPAAEARLCAANPVLPV (SEQ ID NO:608) of R11723_1_P13 (SEQ ID NO:277).

The localization of the variant protein was determined according to results from a number of different software programs and analyses, including analyses from SignalP and other specialized programs. The variant protein is believed to be located as follows with regard to the cell: secreted.

Variant protein R11723_1_P13 (SEQ ID NO:277) is encoded by the following transcript(s): R11723_1_T12 (SEQ ID NO:243) and R11723_1_T8 (SEQ ID NO:239), for which the sequence(s) is/are given at the end of the application.

The coding portion of transcript R11723_1_T12 (SEQ ID NO:243) is shown in bold; this coding portion starts at position 430 and ends at position 546. The transcript also has the following SNPs as listed in Table 297 (given according to their position on the nucleotide sequence, with the alternative nucleic acid listed; the last column indicates whether the SNP is known or not; the presence of known SNPs in variant protein R11723_1_P13 (SEQ ID NO:277) sequence provides support for the deduced sequence of this variant protein according to the present invention).

TABLE 297

| SNP position(s) on nucleotide sequence | Nucleic acid SNPs Alternative nucleic acid(s) | Previously known SNP? |
| --- | --- | --- |
| 238 | G -> | Yes |
| 1227 | C -> T | Yes |
| 1274 | G -> C | Yes |
| 1675 | G -> A | Yes |
| 2031 | A -> C | Yes |
| 2053 | A -> G | Yes |

The coding portion of transcript R11723_1_T8 (SEQ ID NO:239) is shown in bold; this coding portion starts at position 430 and ends at position 546. The transcript also has the following SNPs as listed in Table 298 (given according to their position on the nucleotide sequence, with the alternative nucleic acid listed; the last column indicates whether the SNP is known or not; the presence of known SNPs in variant protein R11723_1_P13 (SEQ ID NO:277) sequence provides support for the deduced sequence of this variant protein according to the present invention).

TABLE 298

| SNP position(s) on nucleotide sequence | Nucleic acid SNPs Alternative nucleic acid(s) | Previously known SNP? |
| --- | --- | --- |
| 238 | G -> | Yes |
| 1074 | C -> T | Yes |
| 1121 | G -> C | Yes |
| 1522 | G -> A | Yes |
| 1878 | A -> C | Yes |
| 1900 | A -> G | Yes |

Variant protein R11723_1_P14 (SEQ ID NO:278) according to the present invention has an amino acid sequence as given at the end of the application; it is encoded by transcript(s) R11723_1_T14 (SEQ ID NO:245) and R11723_1_T9 (SEQ ID NO:240). An alignment is given to the known protein (LY6/PLAUR domain containing 1 (SEQ ID NO:270)) at the end of the application. One or more alignments to one or more previously published protein sequences are given at the end of the application. A brief description of the relationship of the variant protein according to the present invention to each such aligned protein is as follows:

1. Comparison Report Between R11723_1_P14 (SEQ ID NO:278) and Q96AC2_HUMAN (SEQ ID NO:275):

A. An isolated chimeric polypeptide encoding for R11723_1_P14 (SEQ ID NO:278), comprising a first amino acid sequence being at least 90% homologous to MWVLGIAATFCGLFLLPGFALQIQCYQCEEFQLNNDCSSPEFIVNCTVNVQDMCQKEVMEQSA corresponding to amino acids 1-63 of Q96AC2_HUMAN (SEQ ID NO:275), which also corresponds to amino acids 1-63 of R11723_1_P14 (SEQ ID NO:278), and a second amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO:609) corresponding to amino acids 64-84 of R11723_1_P14 (SEQ ID NO:278), wherein said first amino acid sequence and second amino acid sequence are contiguous and in a sequential order.

B. An isolated polypeptide encoding for an edge portion of R11723_1_P14 (SEQ ID NO:278), comprising an amino acid sequence being at least 70%, optionally at least about 80%, preferably at least about 85%, more preferably at least about 90% and most preferably at least about 95% homologous to the sequence DTKRTNTLLFEMRHFAKQLTT (SEQ ID NO:609) of R11723_1_P14 (SEQ ID NO:278).

2. Comparison Report Between R11723_1_P14 (SEQ ID NO:278) and Q6ZWI4_HUMAN (SEQ ID NO:271):

A. An isolated chimeric polypeptide encoding for R11723_1_P14 (SEQ ID NO:278), comprising a first amino acid sequence being at least 90% homologous to MWVLGIAATFCGLFLLPGFALQIQCYQCEEFQLNNDCSSPEFIVNCTVNVQDMCQKEVMEQSA corresponding to amino acids 24-86 of Q6ZWI4_HUMAN (SEQ ID NO:271), which also corresponds to amino acids 1-63 of R11723_1_P14 (SEQ ID NO:278), and a second amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO:609) corresponding to amino acids 64-84 of R11723_1_P14 (SEQ ID NO:278), wherein said, first amino acid sequence and second amino acid sequence are contiguous and in a sequential order.

C. An isolated polypeptide encoding for an edge portion of R11723_1_P14 (SEQ ID NO:278), comprising an amino acid sequence being at least 70%, optionally at least about 80%, preferably at least about 85%, more preferably at least about 90% and most preferably at least about 95% homologous to the sequence DTKRTNTLLFEMRHFAKQLTT (SEQ ID NO:609) of R11723_1_P14 (SEQ ID NO:278).

3. Comparison Report Between R11723_1_P14 (SEQ ID NO:278) and NP_653187:

A. An isolated chimeric polypeptide encoding for R11723_1_P14 (SEQ ID NO:278), comprising a first amino acid sequence being at least 90% homologous to MWVLGIAATFCGLFLLPGFALQIQCYQCEEFQLNNDCSSPEFIVNCTVNVQDMCQKEVMEQSA corresponding to amino acids 1-63 of NP_653187, which also corresponds to amino acids 1-63 of R11723_1_P14 (SEQ ID NO:278), and a second amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO:609) corresponding to amino acids 64-84 of R11723_1_P14 (SEQ ID NO:278), wherein said first amino acid sequence and second amino acid sequence are contiguous and in a sequential order.

B. An isolated polypeptide encoding for an edge portion of R11723_1_P14 (SEQ ID NO:278), comprising an amino acid sequence being at least 70%, optionally at least about 80%, preferably at least about 85%, more preferably at least about 90% and most preferably at least about 95% homologous to the sequence DTKRTNTLLFEMRHFAKQLTT (SEQ ID NO:609) of R11723_1_P14 (SEQ ID NO:278).

4. Comparison Report Between R11723_1_P14 (SEQ ID NO:278) and Q8N2G4_HUMAN (SEQ ID NO:274):

A. An isolated chimeric polypeptide encoding for R11723_1_P14 (SEQ ID NO:278), comprising a first amino acid sequence being at least 90% homologous to MWVLGLAATFCGLFLLPGFALQIQCYQCEEFQLNNDCSSPEFIVNCTVNVQDMCQKEVMEQSA corresponding to amino acids 1-63 of Q8N2G4_HUMAN (SEQ ID NO:274), which also corresponds to amino acids 1-63 of R11723_1_P14 (SEQ ID NO:278), and a second amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO:609) corresponding to amino acids 64-84 of R11723_1_P14 (SEQ ID NO:278), wherein said first amino acid sequence and second amino acid sequence are contiguous and in a sequential order.

B. An isolated polypeptide encoding for an edge portion of R11723_1_P14 (SEQ ID NO:278), comprising an amino acid sequence being at least 70%, optionally at least about 80%, preferably at least about 85%, more preferably at least about 90% and most preferably at least about 95% homologous to the sequence DTKRTNTLLFEMRHFAKQLTT (SEQ ID NO:609) of R11723_1_P14 (SEQ ID NO:278).

5. Comparison Report Between R11723_1_P14 (SEQ ID NO:278) and Q6ZP52_HUMAN (SEQ ID NO:273):

A. An isolated chimeric polypeptide encoding for R11723_1_P14 (SEQ ID NO:278), comprising a first amino acid sequence being at least 70%, optionally at least 80%, preferably at least 85%, more preferably at least 90% and most preferably at least 95%, homologous to a polypeptide having the sequence MWVLG (SEQ ID NO:607) corresponding to amino acids 1-5 of R11723_1_P14 (SEQ ID NO:278), a second amino acid sequence being at least 90% homologous to IAATFCGLFLLPGFALQIQCYQCEEFQLNNDCSSPEFIVNCTVNVQDMCQKEVMEQSA corresponding to amino acids 22-79 of Q6ZP52_HUMAN (SEQ ID NO:273), which also corresponds to amino acids 6-63 of R11723_1_P14 (SEQ ID NO:278), and a third amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO:609) corresponding to amino acids 64-84 of R11723_1_P14 (SEQ ID NO:278), wherein said first amino acid sequence, second amino acid sequence and third amino acid sequence are contiguous and in a sequential order.

B. An isolated polypeptide encoding for a head of R11723_1_P14 (SEQ ID NO:278), comprising a polypeptide being at least 70%, optionally at least about 80%, preferably at least about 85%, more preferably at least about 90% and most preferably at least about 95% homologous to the sequence MWVLG (SEQ ID NO:607) of R11723_1_P14 (SEQ ID NO:278).

C. An isolated polypeptide encoding for an edge portion of R11723_1_P14 (SEQ ID NO:278), comprising an amino acid sequence being at least 70%, optionally at least about 80%, preferably at least about 85%, more preferably at least about 90% and most preferably at least about 95% homologous to the sequence DTKRTNTLLFEMRHFAKQLTT (SEQ ID NO:609) of R11723_1_P14 (SEQ ID NO:278).

The localization of the variant protein was determined according to results from a number of different software programs and analyses, including analyses from SignalP and other specialized programs. The variant protein is believed to be located as follows with regard to the cell: secreted.

Variant protein R11723_1_P14 (SEQ ID NO:278) is encoded by the following transcript(s): R11723_1_T14 (SEQ ID NO:245) and R11723_1_T9 (SEQ ID NO:240), for which the sequence(s) is/are given at the end of the application.

The coding portion of transcript R11723_1_T14 (SEQ ID NO:245) is shown in bold; this coding portion starts at position 430 and ends at position 681. The transcript also has the following SNPs as listed in Table 299 (given according to their position on the nucleotide sequence, with the alternative nucleic acid listed; the last column indicates whether the SNP is known or not; the presence of known SNPs in variant protein R11723_1_P14 (SEQ ID NO:278) sequence provides support for the deduced sequence of this variant protein according to the present invention).

TABLE 299

| SNP position(s) on nucleotide sequence | Nucleic acid SNPs Alternative nucleic acid(s) | Previously known SNP? |
|---|---|---|
| 238 | G -> | Yes |
| 774 | G -> T | Yes |
| 782 | G -> C | Yes |
| 1163 | G -> | Yes |
| 1452 | C -> T | Yes |

The coding portion of transcript R11723_1_T9 (SEQ ID NO:240) is shown in bold; this coding portion starts at position 430 and ends at position 681. The transcript also has the following SNPs as listed in Table 300 (given according to their position on the nucleotide sequence, with the alternative nucleic acid listed; the last column indicates whether the SNP is known or not; the presence of known SNPs in variant protein R11723_1_P14 (SEQ ID NO:278) sequence provides support for the deduced sequence of this variant protein according to the present invention).

TABLE 300

| SNP position(s) on nucleotide sequence | Nucleic acid SNPs Alternative nucleic acid(s) | Previously known SNP? |
|---|---|---|
| 238 | G -> | Yes |
| 1193 | C -> T | Yes |
| 1240 | G -> C | Yes |
| 1641 | G -> A | Yes |
| 1997 | A -> C | Yes |
| 2019 | A -> G | Yes |

Variant protein R11723_1_P15 (SEQ ID NO:279) according to the present invention has an amino acid sequence as given at the end of the application; it is encoded by transcript(s) R11723_1_T13 (SEQ ID NO:244). An alignment is given to the known protein (LY6/PLAUR domain containing 1 (SEQ ID NO:270)) at the end of the application. One or more alignments to one or more previously published protein sequences are given at the end of the application. A brief description of the relationship of the variant protein according to the present invention to each such aligned protein is as follows:

1. Comparison report between R11723_1_P15 (SEQ ID NO:279) and Q96AC2_HUMAN (SEQ ID NO:275):

A. An isolated chimeric polypeptide encoding for R11723_1_P15 (SEQ ID NO:279), comprising a first amino acid sequence being at least 90% homologous to MWVLGIAATFCGLFLLPGFALQIQCYQ-CEEFQLNNDCSSPEFIVNCTVNVQDMCQKEVME QSAG corresponding to amino acids 1-64 of Q96AC2_HUMAN (SEQ ID NO:275), which also corresponds to amino acids 1-64 of R11723_1_P15 (SEQ ID NO:279), and a second amino acid sequence being at least 70%, optionally at least 80%, preferably at least 85%, more preferably at least 90% and most preferably at least 95% homologous to a polypeptide having the sequence SHCVTRLECSGTISAHCNLCLPGSNDHPT (SEQ ID NO:610) corresponding to amino acids 65-93 of R11723_1_P15 (SEQ ID NO:279), wherein said first amino acid sequence and second amino acid sequence are contiguous and in a sequential order.

B. An isolated polypeptide encoding for an edge portion of R11723_1_P15 (SEQ ID NO:279), comprising an amino acid sequence being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO:610) of R11723_1_P15 (SEQ ID NO:279).

2. Comparison Report Between R11723_1_P15 (SEQ ID NO:279) and Q6ZWI4_HUMAN (SEQ ID NO:271):

A. An isolated chimeric polypeptide encoding for R11723_1_P15 (SEQ ID NO:279), comprising a first amino acid sequence being at least 90% homologous to MWVLGIAATFCGLFLLPGFALQIQCYQ-CEEFQLNNDCSSPEFIVNCTVNVQDMCQKEVME QSAG corresponding to amino acids 24-87 of Q6ZWI4_HUMAN (SEQ ID NO:271), which also corresponds to amino acids 1-64 of R11723_1_P15 (SEQ ID NO:279), and a second amino acid sequence being at least 70%, optionally at least 80%, preferably at least 85%, more preferably at least 90% and most preferably at least 95% homologous to a polypeptide having the sequence SHCVTRLECSGTISAHCNLCLPGSNDHPT (SEQ ID NO:610) corresponding to amino acids 65-93 of R11723_1_P15 (SEQ ID NO:279), wherein said, first amino acid sequence and second amino acid sequence are contiguous and in a sequential order.

C. An isolated polypeptide encoding for an edge portion of R11723_1_P15 (SEQ ID NO:279), comprising an amino acid sequence being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO:610) of R11723_1_P15 (SEQ ID NO:279).

3. Comparison Report Between R11723_1_P 15 (SEQ ID NO:279) and NP_653187:

A. An isolated chimeric polypeptide encoding for R11723_1_P15 (SEQ ID NO:279), comprising a first amino acid sequence being at least 90% homologous to MWVL-GIAATFCGLFLLPGFALQIQCYQ-CEEFQLNNDCSSPEFIVNCTVNVQDMCQKEVME QSAG corresponding to amino acids 1-64 of NP_653187, which also corresponds to amino acids 1-64 of R11723_1_P15 (SEQ ID NO:279), and a second amino acid sequence being at least 70%, optionally at least 80%, preferably at least 85%, more preferably at least 90% and most preferably at least 95% homologous to a polypeptide having the sequence SHCVTRLECSGTISAHCNLCLPGSNDHPT (SEQ ID NO:610) corresponding to amino acids 65-93 of R11723_1_P15 (SEQ ID NO:279), wherein said first amino acid sequence and second amino acid sequence are contiguous and in a sequential order.

B. An isolated polypeptide encoding for an edge portion of R11723_1_P15 (SEQ ID NO:279), comprising an amino acid sequence being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO:610) of R11723_1_P15 (SEQ ID NO:279).

4. Comparison Report Between R11723_1_P15 (SEQ ID NO:279) and Q8N2G4_HUMAN (SEQ ID NO:274):

A. An isolated chimeric polypeptide encoding for R11723_1_P15 (SEQ ID NO:279), comprising a first amino acid sequence being at least 90% homologous to MWVL-GIAATFCGLFLLPGFALQIQCYQ-CEEFQLNNDCSSPEFIVNCTVNVQDMCQKEVME QSAG corresponding to amino acids 1-64 of Q8N2G4_HUMAN (SEQ ID NO:274), which also corresponds to amino acids 1-64 of R11723_1_P15 (SEQ ID NO:279), and a second amino acid sequence being at least 70%, optionally at least 80%, preferably at least 85%, more preferably at least 90% and most preferably at least 95% homologous to a polypeptide having the sequence SHCVTR-LECSGTISAHCNLCLPGSNDHPT (SEQ ID NO:610) corresponding to amino acids 65-93 of R11723_1_P15 (SEQ ID NO:279), wherein said first amino acid sequence and second amino acid sequence are contiguous and in a sequential order.

B. An isolated polypeptide encoding for an edge portion of R11723_1_P15 (SEQ ID NO:279), comprising an amino acid sequence being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO:610) of R11723_1_P15 (SEQ ID NO:279).

5. Comparison Report Between R11723_1_P15 (SEQ ID NO:279) and Q6ZP52_HUMAN (SEQ ID NO:273):

A. An isolated chimeric polypeptide encoding for R11723_1_P15 (SEQ ID NO:279), comprising a first amino acid sequence being at least 70%, optionally at least 80%, preferably at least 85%, more preferably at least 90% and most preferably at least 95%, homologous to a polypeptide having the sequence MWVLG (SEQ ID NO:607) corresponding to amino acids 1-5 of R11723_1_P15 (SEQ ID NO:279), a second amino acid sequence being at least 90% homologous to IAATFCGLFLLPGFALQIQCYQ-CEEFQLNNDCSSPEFIVNCTVNVQDMC-QKEVMEQSAG corresponding to amino acids 22-80 of Q6ZP52_HUMAN (SEQ ID NO:273), which also corresponds to amino acids 6-64 of R11723_1_P15 (SEQ ID NO:279), and a third amino acid sequence being at least 70%, optionally at least 80%, preferably at least 85%, more preferably at least 90% and most preferably at least 95% homologous to a polypeptide having the sequence SHCVTRLECS-GTISAHCNLCLPGSNDHPT (SEQ ID NO:610) corresponding to amino acids 65-93 of R11723_1_P15 (SEQ ID NO:279), wherein said first amino acid sequence, second amino acid sequence and third amino acid sequence are contiguous and in a sequential order.

B. An isolated polypeptide encoding for a head of R11723_1_P15 (SEQ ID NO:279), comprising a polypeptide being at least 70%, optionally at least about 80%, preferably at least about 85%, more preferably at least about 90% and most preferably at least about 95% homologous to the sequence MWVLG (SEQ ID NO:607) of R11723_1_P15 (SEQ ID NO:279).

C. An isolated polypeptide encoding for an edge portion of R11723_1_P15 (SEQ ID NO:279), comprising an amino acid sequence being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO:610) of R11723_1_P15 (SEQ ID NO:279).

The localization of the variant protein was determined according to results from a number of different software programs and analyses, including analyses from SignalP and other specialized programs. The variant protein is believed to be located as follows with regard to the cell: secreted.

Variant protein R11723_1_P15 (SEQ ID NO:279) also has the following non-silent SNPs (Single Nucleotide Polymorphisms) as listed in Table 301, (given according to their position(s) on the amino acid sequence, with the alternative amino acid(s) listed; the last column indicates whether the SNP is known or not; the presence of known SNPs in variant protein R11723_1_P15 (SEQ ID NO:279) sequence provides support for the deduced sequence of this variant protein according to the present invention).

TABLE 301

Amino acid mutations

| SNP position(s) on amino acid sequence | Alternative amino acid(s) | Previously known SNP? |
|---|---|---|
| 67 | C -> S | Yes |

Variant protein R11723_1_P15 (SEQ ID NO:279) is encoded by the following transcript(s): R11723_1_T13 (SEQ ID NO:244), for which the sequence(s) is/are given at the end of the application. The coding portion of transcript R11723_1_T13 (SEQ ID NO:244) is shown in bold; this coding portion starts at position 430 and ends at position 708. The transcript also has the following SNPs as listed in Table 302 (given according to their position on the nucleotide sequence, with the alternative nucleic acid listed; the last column indicates whether the SNP is known or not; the presence of known SNPs in variant protein R11723_1_P15 (SEQ ID NO:279) sequence provides support for the deduced sequence of this variant protein according to the present invention).

TABLE 302

| SNP position(s) on nucleotide sequence | Nucleic acid SNPs Alternative nucleic acid(s) | Previously known SNP? |
|---|---|---|
| 238 | G -> | Yes |
| 621 | G -> T | Yes |
| 629 | G -> C | Yes |
| 1010 | G -> | Yes |
| 1299 | C -> T | Yes |

Variant protein R11723_1_P16 (SEQ ID NO:280) according to the present invention has an amino acid sequence as given at the end of the application; it is encoded by transcript(s) R11723_1_T15 (SEQ ID NO:246). An alignment is given to the known protein (LY6/PLAUR domain containing 1 (SEQ ID NO:270)) at the end of the application. One or more alignments to one or more previously published protein sequences are given at the end of the application. A brief description of the relationship of the variant protein according to the present invention to each such aligned protein is as follows:

1. Comparison Report Between R11723_1_P16 (SEQ ID NO:280) and Q96AC2_HUMAN (SEQ ID NO:275):

A. An isolated chimeric polypeptide encoding for R11723_1_P16 (SEQ ID NO:280), comprising a first amino acid sequence being at least 90% homologous to MWVLGIAATFCGLFLLPGFALQIQCYQCEEFQLNNDCSSPEFIVNCTVNVQDMCQKEVMEQSA corresponding to amino acids 1-63 of Q96AC2_HUMAN (SEQ ID NO:275), which also corresponds to amino acids 1-63 of R11723_1_P16 (SEQ ID NO:280), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO:611) corresponding to amino acids 64-90 of R11723_1_P16 (SEQ ID NO:280), wherein said first amino acid sequence and second amino acid sequence are contiguous and in a sequential order.

B. An isolated polypeptide encoding for an edge portion of R11723_1_P16 (SEQ ID NO:280), comprising an amino acid sequence being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:611) of R11723_1_P16 (SEQ ID NO:280).

2. Comparison Report Between R11723_1_P16 (SEQ ID NO:280) and Q6ZWI4_HUMAN (SEQ ID NO:271):

A. An isolated chimeric polypeptide encoding for R11723_1_P16 (SEQ ID NO:280), comprising a first amino acid sequence being at least 90% homologous to MWVLGIAATFCGLFLLPGFALQIQCYQCEEFQLNNDCSSPEFIVNCTVNVQDMCQKEVMEQSA corresponding to amino acids 24-86 of Q6ZWI4_HUMAN (SEQ ID NO:271), which also corresponds to amino acids 1-63 of R11723_1_P16 (SEQ ID NO:280), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO:611) corresponding to amino acids 64-90 of R11723_1_P16 (SEQ ID NO:280), wherein said first amino acid sequence and second amino acid sequence are contiguous and in a sequential order.

C. An isolated polypeptide encoding for an edge portion of R11723_1_P16 (SEQ ID NO:280), comprising an amino acid sequence being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:611) of R11723_1_P16 (SEQ ID NO:280).

3. Comparison Report Between R11723_1_P16 (SEQ ID NO:280) and NP_653187:

A. An isolated chimeric polypeptide encoding for R11723_1_P16 (SEQ ID NO:280), comprising a first amino acid sequence being at least 90% homologous to MWVLGIAATFCGLFLLPGFALQIQCYQCEEFQLNNDCSSPEFIVNCTVNVQDMCQKEVMEQSA corresponding to amino acids 1-63 of NP_653187, which also corresponds to amino acids 1-63 of R11723_1_P16 (SEQ ID NO:280), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO:611) corresponding to amino acids 64-90 of R11723_1_P16 (SEQ ID NO:280), wherein said first amino acid sequence and second amino acid sequence are contiguous and in a sequential order.

B. An isolated polypeptide encoding for an edge portion of R11723_1_P16 (SEQ ID NO:280), comprising an amino acid sequence being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:611) of R11723_1_P16 (SEQ ID NO:280).

4. Comparison Report Between R11723_1_P16 (SEQ ID NO:280) and Q8N2G4_HUMAN (SEQ ID NO:274):

A. An isolated chimeric polypeptide encoding for R11723_1_P16 (SEQ ID NO:280), comprising a first amino acid sequence being at least 90% homologous to MWVLGIAATFCGLFLLPGFALQIQCYQCEEFQLNNDCSSPEFIVNCTVNVQDMCQKEVMEQSA corresponding to amino acids 1-63 of Q8N2G4_HUMAN (SEQ ID NO:274), which also corresponds to amino acids 1-63 of R11723_1_P16 (SEQ ID NO:280), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO:61 1) corresponding to amino acids 64-90 of R11723_1_P16 (SEQ ID NO:280), wherein said first amino acid sequence and second amino acid sequence are contiguous and in a sequential order.

B. An isolated polypeptide encoding for an edge portion of R11723_1_P16 (SEQ ID NO:280), comprising an amino acid sequence being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:611) of R11723_1_P16 (SEQ IDNO:280).

5. Comparison Report Between R11723_1_P16 (SEQ ID NO:280) and Q6ZP52_HUMAN (SEQ ID NO:273):

A. An isolated chimeric polypeptide encoding for R11723_1_P16 (SEQ ID NO:280), comprising a first amino acid sequence being at least 70%, optionally at least 80%, preferably at least 85%, more preferably at least 90% and most preferably at least 95%, homologous to a polypeptide having the sequence MWVLG (SEQ ID NO:607) corresponding to amino acids 1-5 of R11723_1_P16 (SEQ ID NO:280), a second amino acid sequence being at least 90% homologous to IAATFCGLFLLPGFALQIQCYQCEEFQLNNDCS SPEFIVNCTVNVQDMCQKEVMEQSA corresponding to amino acids 22-79 of Q6ZP52_HUMAN (SEQ ID NO:273), which also corresponds to amino acids 6-63 of R11723_1_P16 (SEQ ID NO:280), and a third amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO:611) corresponding to amino acids 64-90 of R11723_1_P16 (SEQ ID NO:280), wherein said first amino acid sequence, second amino acid sequence and third amino acid sequence are contiguous and in a sequential order.

B. An isolated polypeptide encoding for a head of R11723_1_P16 (SEQ ID NO:280), comprising a polypeptide being at least 70%, optionally at least about 80%, preferably at least about 85%, more preferably at least about 90% and most preferably at least about 95% homologous to the sequence MWVLG (SEQ ID NO:607) of R11723_1_P16 (SEQ ID NO:280).

C. An isolated polypeptide encoding for an edge portion of R11723_1_P16 (SEQ ID NO:280), comprising an amino acid sequence being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:611) of R11723_1_P16 (SEQ ID NO:280).

The localization of the variant protein was determined according to results from a number of different software programs and analyses, including analyses from SignalP and other specialized programs. The variant protein is believed to be located as follows with regard to the cell: secreted.

Variant protein R11723_1_P16 (SEQ ID NO:280) also has the following non-silent SNPs (Single Nucleotide Polymorphisms) as listed in Table 303, (given according to their position(s) on the amino acid sequence, with the alternative amino acid(s) listed; the last column indicates whether the SNP is known or not; the presence of known SNPs in variant protein R11723_1_P16 (SEQ ID NO:280) sequence provides support for the deduced sequence of this variant protein according to the present invention).

TABLE 303

Amino acid mutations

| SNP position(s) on amino acid sequence | Alternative amino acid(s) | Previously known SNP? |
| --- | --- | --- |
| 66 | V -> F | Yes |

Variant protein R11723_1_P16 (SEQ ID NO:280) is encoded by the following transcript(s): R117231_1_T15 (SEQ ID NO:246), for which the sequence(s) is/are given at the end of the application. The coding portion of transcript R11723_1_T15 (SEQ ID NO:246) is shown in bold; this coding portion starts at position 430 and ends at position 699. The transcript also has the following SNPs as listed in Table 304 (given according to their position on the nucleotide sequence, with the alternative nucleic acid listed; the last column indicates whether the SNP is known or not; the presence of known SNPs in variant protein R11723_1_P16 (SEQ ID NO:280) sequence provides support for the deduced sequence of this variant protein according to the present invention).

TABLE 304

Nucleic acid SNPs

| SNP position(s) on nucleotide sequence | Alternative nucleic acid(s) | Previously known SNP? |
| --- | --- | --- |
| 238 | G -> | Yes |
| 625 | G -> T | Yes |
| 633 | G -> C | Yes |
| 1014 | G -> | Yes |
| 1303 | C -> T | Yes |

Variant protein R11723_1_P19 (SEQ ID NO:281) according to the present invention has an amino acid sequence as given at the end of the application; it is encoded by transcript(s) R11723_1_T10 (SEQ ID NO:241), R11723_1_T11 (SEQ ID NO:242), R11723_1_T12 (SEQ ID NO:243), R11723_1_T8 (SEQ ID NO:239) and R11723_1_T9 (SEQ ID NO:240).

The localization of the variant protein was determined according to results from a number of different software programs and analyses, including analyses from SignalP and other specialized programs. The variant protein is believed to be located as follows with regard to the cell: secreted.

Variant protein R11723_1_P19 (SEQ ID NO:281) also has the following non-silent SNPs (Single Nucleotide Polymorphisms) as listed in Table 305, (given according to their position(s) on the amino acid sequence, with the alternative amino acid(s) listed; the last column indicates whether the SNP is known or not; the presence of known SNPs in variant protein R11723_1_P19 (SEQ ID NO:281) sequence provides support for the deduced sequence of this variant protein according to the present invention).

TABLE 305

Amino acid mutations

| SNP position(s) on amino acid sequence | Alternative amino acid(s) | Previously known SNP? |
| --- | --- | --- |
| 107 | H -> P | Yes |

Variant protein R11723_1_P19 (SEQ ID NO:281) is encoded by the following transcript(s): R11723_1_T10 (SEQ ID NO:241), R11723_1_T11 (SEQ ID NO:242), R11723_1_T12 (SEQ ID NO:243), R11723_1_T8 (SEQ ID NO:239) and R11723_1_T9 (SEQ ID NO:240), for which the sequence(s) is/are given at the end of the application.

The coding portion of transcript R11723_1_T10 (SEQ ID NO:241) is shown in bold; this coding portion starts at position 1363 and ends at position 1698. The transcript also has the following SNPs as listed in Table 306 (given according to their position on the nucleotide sequence, with the alternative nucleic acid listed; the last column indicates whether the SNP is known or not; the presence of known SNPs in variant protein R11723_1_P19 (SEQ ID NO:281) sequence provides support for the deduced sequence of this variant protein according to the present invention).

TABLE 306

Nucleic acid SNPs

| SNP position(s) on nucleotide sequence | Alternative nucleic acid(s) | Previously known SNP? |
|---|---|---|
| 202 | G -> A | Yes |
| 878 | C -> T | Yes |
| 925 | G -> C | Yes |
| 1326 | G -> A | Yes |
| 1682 | A -> C | Yes |
| 1704 | A -> G | Yes |

The coding portion of transcript R11723_1_T11 (SEQ ID NO:242) is shown in bold; this coding portion starts at position 1071 and ends at position 1406. The transcript also has the following SNPs as listed in Table 307 (given according to their position on the nucleotide sequence, with the alternative nucleic acid listed; the last column indicates whether the SNP is known or not; the presence of known SNPs in variant protein R11723_1_P19 (SEQ ID NO:281) sequence provides support for the deduced sequence of this variant protein according to the present invention).

TABLE 307

Nucleic acid SNPs

| SNP position(s) on nucleotide sequence | Alternative nucleic acid(s) | Previously known SNP? |
|---|---|---|
| 586 | C -> T | Yes |
| 633 | G -> C | Yes |
| 1034 | G -> A | Yes |
| 1390 | A -> C | Yes |
| 1412 | A -> G | Yes |

The coding portion of transcript R11723_1_T12 (SEQ ID NO:243) is shown in bold; this coding portion starts at position 1712 and ends at position 2047. The transcript also has the following SNPs as listed in Table 308 (given according to their position on the nucleotide sequence, with the alternative nucleic acid listed; the last column indicates whether the SNP is known or not; the presence of known SNPs in variant protein R11723_1_P19 (SEQ ID NO:281) sequence provides support for the deduced sequence of this variant protein according to the present invention).

TABLE 308

Nucleic acid SNPs

| SNP position(s) on nucleotide sequence | Alternative nucleic acid(s) | Previously known SNP? |
|---|---|---|
| 238 | G -> | Yes |
| 1227 | C -> T | Yes |
| 1274 | G -> C | Yes |
| 1675 | G -> A | Yes |
| 2031 | A -> C | Yes |
| 2053 | A -> G | Yes |

The coding portion of transcript R11723_1_T8 (SEQ ID NO:239) is shown in bold; this coding portion starts at position 1559 and ends at position 1894. The transcript also has the following SNPs as listed in Table 309 (given according to their position on the nucleotide sequence, with the alternative nucleic acid listed; the last column indicates whether the SNP is known or not; the presence of known SNPs in variant protein R11723_1_P19 (SEQ ID NO:281) sequence provides support for the deduced sequence of this variant protein according to the present invention).

TABLE 309

Nucleic acid SNPs

| SNP position(s) on nucleotide sequence | Alternative nucleic acid(s) | Previously known SNP? |
|---|---|---|
| 238 | G -> | Yes |
| 1074 | C -> T | Yes |
| 1121 | G -> C | Yes |
| 1522 | G -> A | Yes |
| 1878 | A -> C | Yes |
| 1900 | A -> G | Yes |

The coding portion of transcript R11723_1_T9 (SEQ ID NO:240) is shown in bold; this coding portion starts at position 1678 and ends at position 2013. The transcript also has the following SNPs as listed in Table 310 (given according to their position on the nucleotide sequence, with the alternative nucleic acid listed; the last column indicates whether the SNP is known or not; the presence of known SNPs in variant protein R11723_1_P19 (SEQ ID NO:281) sequence provides support for the deduced sequence of this variant protein according to the present invention).

TABLE 310

Nucleic acid SNPs

| SNP position(s) on nucleotide sequence | Alternative nucleic acid(s) | Previously known SNP? |
|---|---|---|
| 238 | G -> | Yes |
| 1193 | C -> T | Yes |
| 1240 | G -> C | Yes |
| 1641 | G -> A | Yes |
| 1997 | A -> C | Yes |
| 2019 | A -> G | Yes |

Variant protein R11723_1_P11 (SEQ ID NO:641) according to the present invention has an amino acid sequence as given at the end of the application; it is encoded by transcript(s) R11723_1_T10.

The localization of the variant protein was determined according to results from a number of different software programs and analyses, including analyses from SignalP and other specialized programs. The variant protein is believed to be located as follows with regard to the cell: intracellularly.

Variant protein R11723_1_P11 (SEQ ID NO:641) also has the following non-silent SNPs (Single Nucleotide Polymorphisms) as listed in Table 311, (given according to their position(s) on the amino acid sequence, with the alternative amino acid(s) listed; the last column indicates whether the SNP is known or not; the presence of known SNPs in variant protein R11723_1_P11 (SEQ ID NO:641) sequence provides support for the deduced sequence of this variant protein according to the present invention).

TABLE 311

Amino acid mutations

| SNP position(s) on amino acid sequence | Alternative amino acid(s) | Previously known SNP? |
|---|---|---|
| 67 | R -> Q | Yes |

Variant protein R11723_1_P11 (SEQ ID NO:641) is encoded by the following transcript(s): R11723_1_T10, for which the sequence(s) is/are given at the end of the application. The coding portion of transcript R11723_1_T10 is shown in bold; this coding portion starts at position 3 and ends at position 350. The transcript also has the following SNPs as listed in Table 312 (given according to their position on the nucleotide sequence, with the alternative nucleic acid listed; the last column indicates whether the SNP is known or not; the presence of known SNPs in variant protein R11723_1_P11 (SEQ ID NO:641) sequence provides support for the deduced sequence of this variant protein according to the present invention).

TABLE 312

Nucleic acid SNPs

| SNP position(s) on nucleotide sequence | Alternative nucleic acid(s) | Previously known SNP? |
|---|---|---|
| 202 | G -> A | Yes |
| 878 | C -> T | Yes |
| 925 | G -> C | Yes |
| 1326 | G -> A | Yes |
| 1682 | A -> C | Yes |
| 1704 | A -> G | Yes |

Variant protein R11723_1_P12 (SEQ ID NO:642) according to the present invention has an amino acid sequence as given at the end of the application; it is encoded by transcript(s) R11723_1_T11. An alignment is given to the known protein (LY6/PLAUR domain containing 1) at the end of the application. One or more alignments to one or more previously published protein sequences are given at the end of the application. A brief description of the relationship of the variant protein according to the present invention to each such aligned protein is as follows:

1. Comparison Report Between R11723_1_P12 (SEQ ID NO:642) and Q96AC2_HUMAN:

A. An isolated chimeric polypeptide encoding for R11723_1_P12 (SEQ ID NO:642), comprising a first amino acid sequence being at least 70%, optionally at least 80%, preferably at least 85%, more preferably at least 90% and most preferably at least 95%, homologous to a polypeptide having the sequence EPDCVCLA (SEQ ID NO:643) corresponding to amino acids 1-8 of R11723_1_P12 (SEQ ID NO:642), and a second amino acid sequence being at least 90% homologous to GFALQIQCYQCEEFQLNNDCSSPEFIVNCTVNVQDMCQKEVMEQSAGIMYRKSCASSAA CLIASAGYQSFCSPGKLNSVCISCCNTPLCNGPRPKKRGSSASALRPGL RTTILFLKLALFSA HC corresponding to amino acids 18-141 of Q96AC2_HUMAN, which also corresponds to amino acids 9-132 of R11723_1_P12 (SEQ ID NO:642), wherein said first amino acid sequence and second amino acid sequence are contiguous and in a sequential order.

B. An isolated polypeptide encoding for a head of R11723_1_P12 (SEQ ID NO:642), comprising a polypeptide being at least 70%, optionally at least about 80%, preferably at least about 85%, more preferably at least about 90% and most preferably at least about 95% homologous to the sequence EPDCVCLA (SEQ ID NO:643) of R11723_1_P12 (SEQ ID NO:642).

2. Comparison Report Between R11723_1_P12 (SEQ ID NO:642) and Q6ZP52_HUMAN:

A. An isolated chimeric polypeptide encoding for R11723_1_P12 (SEQ ID NO:642), comprising a first amino acid sequence being at least 70%, optionally at least 80%, preferably at least 85%, more preferably at least 90% and most preferably at least 95%, homologous to a polypeptide having the sequence EPDCVCLA (SEQ ID NO:643) corresponding to amino acids 1-8 of R11723_1_P12 (SEQ ID NO:642), and a second amino acid sequence being at least 90% homologous to GFALQIQCYQCEEFQLNNDCSSPEFIVNCTVNVQDMCQKEVMEQSAGIMYRKSCASSAA CLIASAGYQSFCSPGKLNSVCISCCNTPLCNGPRPKKRGSSASALRPGL RTTILFLKLALFSA HC corresponding to amino acids 34-157 of Q6ZP52_HUMAN, which also corresponds to amino acids 9-132 of R11723_1_P12 (SEQ ID NO:642), wherein said first amino acid sequence and second amino acid sequence are contiguous and in a sequential order.

B. An isolated polypeptide encoding for a head of R11723_1_P12 (SEQ ID NO:642), comprising a polypeptide being at least 70%, optionally at least about 80%, preferably at least about 85%, more preferably at least about 90% and most preferably at least about 95% homologous to the sequence EPDCVCLA (SEQ ID NO:643) of R11723_1_P12 (SEQ ID NO:642).

3. Comparison report between R11723_1_P12 (SEQ ID NO:642) and Q6ZWI4_HUMAN:

A. An isolated chimeric polypeptide encoding for R11723_1_P12 (SEQ ID NO:642), comprising a first amino acid sequence being at least 70%, optionally at least 80%, preferably at least 85%, more preferably at least 90% and most preferably at least 95%, homologous to a polypeptide having the sequence EPDCVCLA (SEQ ID NO:643) corresponding to amino acids 1-8 of R11723_1_P12 (SEQ ID NO:642), a second amino acid sequence being at least 90% homologous to GFALQIQCYQCEEFQLNNDCSSPEFIVNCTVNVQDMCQKEVMEQSAGIMYRKSCASSAA CLIASAGYQSFCSPGKLNSVCISCCNTPLC corresponding to amino acids 41-129 of Q6ZWI4_HUMAN, which also corresponds to amino acids 9-97 of R11723_1_P12 (SEQ ID NO:642), a bridging amino acid N corresponding to amino acid 98 of R11723_1_P12 (SEQ ID NO:642), a third amino acid sequence being at least 90% homologous to GPRPKKRGSSASALRPGLRTTILFL corresponding to amino acids 131-155 of Q6ZWI4_HUMAN, which also corresponds to amino acids 99-123 of R11723_1_P12 (SEQ ID NO:642), a bridging amino acid K corresponding to amino acid 124 of R11723_1_P12 (SEQ ID NO:642), and a fourth amino acid sequence being at least 90% homologous to LALFSAHC corresponding to amino acids 157-164 of Q6ZWI4_HUMAN, which also corresponds to amino acids 125-132 of R11723_1_P12 (SEQ ID NO:642), wherein said first amino acid sequence, second amino acid sequence, bridging amino acid, third amino acid sequence, bridging amino acid and fourth amino acid sequence are contiguous and in a sequential order.

B. An isolated polypeptide encoding for a head of R11723_1_P12 (SEQ ID NO:642), comprising a polypeptide being at least 70%, optionally at least about 80%, preferably at least about 85%, more preferably at least about 90% and most preferably at least about 95% homologous to the sequence EPDCVCLA (SEQ ID NO:643) of R11723_1_P12 (SEQ ID NO:642).

4. Comparison Report Between R11723_1_P12 (SEQ ID NO:642) and NP_653187:

A. An isolated chimeric polypeptide encoding for R11723_1_P12 (SEQ ID NO:642), comprising a first amino acid sequence being at least 70%, optionally at least 80%, preferably at least 85%, more preferably at least 90% and most preferably at least 95%, homologous to a polypeptide having the sequence EPDCVCLA (SEQ ID NO:643) corresponding to amino acids 1-8 of R11723_1_P12 (SEQ ID NO:642), a second amino acid sequence being at least 90% homologous to GFALQIQCYQCEEFQLNNDCSSPEFIVNCTVNVQDMCQKEVMEQSAGIMYRKSCASSAA CLIASAGYQSFCSPGKLNSVCISCCNTPLCNGPRPKKRGSSASALRPGL RTTILFLKLA corresponding to amino acids 18-135 of NP_653187, which also corresponds to amino acids 9-126 of R11723_1_P12 (SEQ ID NO:642), and a third amino acid sequence being at least 70%, optionally at least 80%, preferably at least 85%, more preferably at least 90% and most preferably at least 95% homologous to a polypeptide having the sequence LFSAHC (SEQ ID NO:644) corresponding to amino acids 127-132 of R11723_1_P12 (SEQ ID NO:642), wherein said first amino acid sequence, second amino acid sequence and third amino acid sequence are contiguous and in a sequential order.

B. An isolated polypeptide encoding for a head of R11723_1_P12 (SEQ ID NO:642), comprising a polypeptide being at least 70%, optionally at least about 80%, preferably at least about 85%, more preferably at least about 90% and most preferably at least about 95% homologous to the sequence EPDCVCLA (SEQ ID NO:643) of R11723_1_P12 (SEQ ID NO:642).

C. An isolated polypeptide encoding for an edge portion of R11723_1_P12 (SEQ ID NO:642), comprising an amino acid sequence being at least 70%, optionally at least about 80%, preferably at least about 85%, more preferably at least about 90% and most preferably at least about 95% homologous to the sequence LFSAHC (SEQ ID NO:644) of R11723_1_P12 (SEQ ID NO:642).

5. Comparison report between R11723_1_P12 (SEQ ID NO:642) and Q8N2G4_HUMAN:

A. An isolated chimeric polypeptide encoding for R11723_1_P12 (SEQ ID NO:642), comprising a first amino acid sequence being at least 70%, optionally at least 80%, preferably at least 85%, more preferably at least 90% and most preferably at least 95%, homologous to a polypeptide having the sequence EPDCVCLA (SEQ ID NO:643) corresponding to amino acids 1-8 of R11723_1_P12 (SEQ ID NO:642), a second amino acid sequence being at least 90% homologous to GFALQIQCYQCEEFQLNNDCSSPEFIVNCTVNVQDMCQKEVMEQSAGIMYRKSCASSAA CLIASAGYQSFCSPGKLNSVCISCCNTPLCNGPRPKKRGSSASALRPGL RTTILFLKLA corresponding to amino acids 18-135 of Q8N2G4_HUMAN, which also corresponds to amino acids 9-126 of R11723_1_P12 (SEQ ID NO:642), and a third amino acid sequence being at least 70%, optionally at least 80%, preferably at least 85%, more preferably at least 90% and most preferably at least 95% homologous to a polypeptide having the sequence LFSAHC (SEQ ID NO:644) corresponding to amino acids 127-132 of R11723_1_P12 (SEQ ID NO:642), wherein said first amino acid sequence, second amino acid sequence and third amino acid sequence are contiguous and in a sequential order.

B. An isolated polypeptide encoding for a head of R11723_1_P12 (SEQ ID NO:642), comprising a polypeptide being at least 70%, optionally at least about 80%, preferably at least about 85%, more preferably at least about 90% and most preferably at least about 95% homologous to the sequence EPDCVCLA (SEQ ID NO:643) of R11723_1_P12 (SEQ ID NO:642).

C. An isolated polypeptide encoding for an edge portion of R11723_1_P12 (SEQ ID NO:642), comprising an amino acid sequence being at least 70%, optionally at least about 80%, preferably at least about 85%, more preferably at least about 90% and most preferably at least about 95% homologous to the sequence LFSAHC (SEQ ID NO:644) of R11723_1_P12 (SEQ ID NO:642).

The localization of the variant protein was determined according to results from a number of different software programs and analyses, including analyses from SignalP and other specialized programs. The variant protein is believed to be located as follows with regard to the cell: intracellularly.

The variant protein has the following domains, as determined by using InterPro. The domains are described in Table 313:

TABLE 313

| InterPro domain(s) | | |
| --- | --- | --- |
| Domain description | Analysis type | Position(s) on protein |
| EGF-like | ScanRegExp | 4-19 |

Variant protein R11723_1_P12 (SEQ ID NO:642) is encoded by the following transcript(s): R11723_1_T11, for which the sequence(s) is/are given at the end of the application. The coding portion of transcript R11723_1_T11 is shown in bold; this coding portion starts at position 3 and ends at position 398. The transcript also has the following SNPs as listed in Table 314 (given according to their position on the nucleotide sequence, with the alternative nucleic acid listed; the last column indicates whether the SNP is known or not; the presence of known SNPs in variant protein R11723_1_P12 (SEQ ID NO:642) sequence provides support for the deduced sequence of this variant protein according to the present invention).

TABLE 314

| Nucleic acid SNPs | | |
| --- | --- | --- |
| SNP position(s) on nucleotide sequence | Alternative nucleic acid(s) | Previously known SNP? |
| 586 | C -> T | Yes |
| 633 | G -> C | Yes |
| 1034 | G -> A | Yes |

TABLE 314-continued

Nucleic acid SNPs

| SNP position(s) on nucleotide sequence | Alternative nucleic acid(s) | Previously known SNP? |
|---|---|---|
| 1390 | A -> C | Yes |
| 1412 | A -> G | Yes |

As noted above, cluster R11723 features 23 segment(s), which were listed in Table 291 above and for which the sequence(s) are given at the end of the application. These segment(s) are portions of nucleic acid sequence(s) which are described herein separately because they are of particular interest. A description of each segment according to the present invention is now provided.

Segment cluster R11723_1_N0 (SEQ ID NO:247) according to the present invention is supported by 8 libraries. The number of libraries was determined as previously described. This segment can be found in the following transcript(s): R11723_1_T10 (SEQ ID NO:241). Table 315 below describes the starting and ending position of this segment on each transcript.

TABLE 315

Segment location on transcripts

| Transcript name | Segment starting position | Segment ending position |
|---|---|---|
| R11723_1_T10 (SEQ ID NO: 241) | 1 | 319 |

Segment cluster R11723_1_N2 (SEQ ID NO:248) according to the present invention is supported by 40 libraries. The number of libraries was determined as previously described. This segment can be found in the following transcript(s): R11723_1_T12 (SEQ ID NO:243), R11723_1_T13 (SEQ ID NO:244), R11723_1_T14 (SEQ ID NO:245), R11723_1_T15 (SEQ ID NO:246), R11723_1_T7 (SEQ ID NO:238), R11723_1_T8 (SEQ ID NO:239) and R11723_1_T9 (SEQ ID NO:240). Table 316 below describes the starting and ending position of this segment on each transcript.

TABLE 316

Segment location on transcripts

| Transcript name | Segment starting position | Segment ending position |
|---|---|---|
| R11723_1_T12 (SEQ ID NO: 243) | 1 | 305 |
| R11723_1_T13 (SEQ ID NO: 244) | 1 | 305 |
| R11723_1_T14 (SEQ ID NO: 245) | 1 | 305 |
| R11723_1_T15 (SEQ ID NO: 246) | 1 | 305 |
| R11723_1_T7 (SEQ ID NO: 238) | 1 | 305 |
| R11723_1_T8 (SEQ ID NO: 239) | 1 | 305 |
| R11723_1_T9 (SEQ ID NO: 240) | 1 | 305 |

Segment cluster R11723_1_N14 (SEQ ID NO:249) according to the present invention is supported by 6 libraries. The number of libraries was determined as previously described. This segment can be found in the following transcript(s): R11723_1_T12 (SEQ ID NO:243), R11723_1_T14 (SEQ ID NO:245) and R11723_1_T9 (SEQ ID NO:240). Table 317 below describes the starting and ending position of this segment on each transcript.

TABLE 317

Segment location on transcripts

| Transcript name | Segment starting position | Segment ending position |
|---|---|---|
| R11723_1_T12 (SEQ ID NO: 243) | 654 | 806 |
| R11723_1_T14 (SEQ ID NO: 245) | 620 | 772 |
| R11723_1_T9 (SEQ ID NO: 240) | 620 | 772 |

Segment cluster R11723_1_N17 (SEQ ID NO:250) according to the present invention is supported by 3 libraries. The number of libraries was determined as previously described. This segment can be found in the following transcript(s): R11723_1_T13 (SEQ ID NO:244), R11723_1_T14 (SEQ ID NO:245) and R11723_1_T15 (SEQ ID NO:246). Table 318 below describes the starting and ending position of this segment on each transcript.

TABLE 318

Segment location on transcripts

| Transcript name | Segment starting position | Segment ending position |
|---|---|---|
| R11723_1_T13 (SEQ ID NO: 244) | 620 | 1353 |
| R11723_1_T14 (SEQ ID NO: 245) | 773 | 1506 |
| R11723_1_T15 (SEQ ID NO: 246) | 624 | 1357 |

Segment cluster R11723_1_N20 (SEQ ID NO:251) according to the present invention is supported by 55 libraries. The number of libraries was determined as previously described. This segment can be found in the following transcript(s): R11723_1_T10 (SEQ ID NO:241), R11723_1_T11 (SEQ ID NO:242), R11723_1_T12 (SEQ ID NO:243), R11723_1_T8 (SEQ ID NO:239) and R11723_1_T9 (SEQ ID NO:240). Table 319 below describes the starting and ending position of this segment on each transcript.

TABLE 319

Segment location on transcripts

| Transcript name | Segment starting position | Segment ending position |
|---|---|---|
| R11723_1_T10 (SEQ ID NO: 241) | 516 | 689 |
| R11723_1_T11 (SEQ ID NO: 242) | 224 | 397 |
| R11723_1_T12 (SEQ ID NO: 243) | 865 | 1038 |
| R11723_1_T8 (SEQ ID NO: 239) | 712 | 885 |
| R11723_1_T9 (SEQ ID NO: 240) | 831 | 1004 |

Segment cluster R11723_1_N23 (SEQ ID NO:252) according to the present invention is supported by 38 libraries. The number of libraries was determined as previously described. This segment can be found in the following transcript(s): R11723_1_T10 (SEQ ID NO:241), R11723_1_T11 (SEQ ID NO:242), R11723_1_T12 (SEQ ID NO:243), R11723_1_T8 (SEQ ID NO:239) and R11723_1_T9 (SEQ ID NO:240). Table 320 below describes the starting and ending position of this segment on each transcript.

TABLE 320

Segment location on transcripts

| Transcript name | Segment starting position | Segment ending position |
|---|---|---|
| R11723_1_T10 (SEQ ID NO: 241) | 764 | 1250 |
| R11723_1_T11 (SEQ ID NO: 242) | 472 | 958 |
| R11723_1_T12 (SEQ ID NO: 243) | 1113 | 1599 |
| R11723_1_T8 (SEQ ID NO: 239) | 960 | 1446 |
| R11723_1_T9 (SEQ ID NO: 240) | 1079 | 1565 |

Segment cluster R11723_1_N25 (SEQ ID NO:253) according to the present invention is supported by 12 libraries. The number of libraries was determined as previously described. This segment can be found in the following transcript(s): R11723_1_T10 (SEQ ID NO:241), R11723_1_T11 (SEQ ID NO:242), R11723_1_T12 (SEQ ID NO:243), R11723_1_T7 (SEQ ID NO:238), R11723_1_T8 (SEQ ID NO:239) and R11723_1_T9 (SEQ ID NO:240). Table 321 below describes the starting and ending position of this segment on each transcript.

TABLE 321

Segment location on transcripts

| Transcript name | Segment starting position | Segment ending position |
|---|---|---|
| R11723_1_T10 (SEQ ID NO: 241) | 1281 | 1609 |
| R11723_1_T11 (SEQ ID NO: 242) | 989 | 1317 |
| R11723_1_T12 (SEQ ID NO: 243) | 1630 | 1958 |
| R11723_1_T7 (SEQ ID NO: 238) | 678 | 1006 |
| R11723_1_T8 (SEQ ID NO: 239) | 1477 | 1805 |
| R11723_1_T9 (SEQ ID NO: 240) | 1596 | 1924 |

Segment cluster R11723_1_N27 (SEQ ID NO:254) according to the present invention is supported by 9 libraries. The number of libraries was determined as previously described. This segment can be found in the following transcript(s): R11723_1_T10 (SEQ ID NO:241), R11723_1_T11 (SEQ ID NO:242), R11723_1_T12 (SEQ ID NO:243), R11723_1_T7 (SEQ ID NO:238), R11723_1_T8 (SEQ ID NO:239) and R11723_1_T9 (SEQ ID NO:240). Table 322 below describes the starting and ending position of this segment on each transcript.

TABLE 322

Segment location on transcripts

| Transcript name | Segment starting position | Segment ending position |
|---|---|---|
| R11723_1_T10 (SEQ ID NO: 241) | 1659 | 1973 |
| R11723_1_T11 (SEQ ID NO: 242) | 1367 | 1681 |
| R11723_1_T12 (SEQ ID NO: 243) | 2008 | 2322 |
| R11723_1_T7 (SEQ ID NO: 238) | 1056 | 1370 |
| R11723_1_T8 (SEQ ID NO: 239) | 1855 | 2169 |
| R11723_1_T9 (SEQ ID NO: 240) | 1974 | 2288 |

According to an optional embodiment of the present invention, short segments related to the above cluster are also provided. These segments are up to about 120 bp in length, and so are included in a separate description.

Segment cluster R11723_1_N3 (SEQ ID NO:255) according to the present invention is supported by 37 libraries. The number of libraries was determined as previously described. This segment can be found in the following transcript(s): R11723_1_T12 (SEQ ID NO:243), R11723_1_T13 (SEQ ID NO:244), R11723_1_T14 (SEQ ID NO:245), R11723_1_T15 (SEQ ID NO:246), R11723_1_T7 (SEQ ID NO:238), R11723_1_T8 (SEQ ID NO:239) and R11723_1_T9 (SEQ ID NO:240). Table 323 below describes the starting and ending position of this segment on each transcript.

TABLE 323

Segment location on transcripts

| Transcript name | Segment starting position | Segment ending position |
|---|---|---|
| R11723_1_T12 (SEQ ID NO: 243) | 306 | 315 |
| R11723_1_T13 (SEQ ID NO: 244) | 306 | 315 |
| R11723_1_T14 (SEQ ID NO: 245) | 306 | 315 |
| R11723_1_T15 (SEQ ID NO: 246) | 306 | 315 |
| R11723_1_T7 (SEQ ID NO: 238) | 306 | 315 |
| R11723_1_T8 (SEQ ID NO: 239) | 306 | 315 |
| R11723_1_T9 (SEQ ID NO: 240) | 306 | 315 |

Segment cluster R11723_1_N4 (SEQ ID NO:256) according to the present invention is supported by 37 libraries. The number of libraries was determined as previously described. This segment can be found in the following transcript(s): R11723_1_T12 (SEQ ID NO:243), R11723_1_T13 (SEQ ID NO:244), R11723_1_T14 (SEQ ID NO:245), R11723_1_T15 (SEQ ID NO:246), R11723_1_T7 (SEQ ID NO:238), R11723_1_T8 (SEQ ID NO:239) and R11723_1_T9 (SEQ ID NO:240). Table 324 below describes the starting and ending position of this segment on each transcript.

TABLE 324

Segment location on transcripts

| Transcript name | Segment starting position | Segment ending position |
|---|---|---|
| R11723_1_T12 (SEQ ID NO: 243) | 316 | 367 |
| R11723_1_T13 (SEQ ID NO: 244) | 316 | 367 |
| R11723_1_T14 (SEQ ID NO: 245) | 316 | 367 |
| R11723_1_T15 (SEQ ID NO: 246) | 316 | 367 |
| R11723_1_T7 (SEQ ID NO: 238) | 316 | 367 |
| R11723_1_T8 (SEQ ID NO: 239) | 316 | 367 |
| R11723_1_T9 (SEQ ID NO: 240) | 316 | 367 |

Segment cluster R11723_1_N5 (SEQ ID NO:257) according to the present invention is supported by 38 libraries. The number of libraries was determined as previously described. This segment can be found in the following transcript(s): R11723_1_T12 (SEQ ID NO:243), R11723_1_T13 (SEQ ID NO:244), R11723_1_T14 (SEQ ID NO:245), R11723_1_T15 (SEQ ID NO:246), R11723_1_T7 (SEQ ID NO:238), R11723_1_T8 (SEQ ID NO:239) and R11723_1_T9 (SEQ ID NO:240). Table 325 below describes the starting and ending position of this segment on each transcript.

TABLE 325

Segment location on transcripts

| Transcript name | Segment starting position | Segment ending position |
|---|---|---|
| R11723_1_T12 (SEQ ID NO: 243) | 368 | 410 |
| R11723_1_T13 (SEQ ID NO: 244) | 368 | 410 |
| R11723_1_T14 (SEQ ID NO: 245) | 368 | 410 |

TABLE 325-continued

Segment location on transcripts

| Transcript name | Segment starting position | Segment ending position |
|---|---|---|
| R11723_1_T15 (SEQ ID NO: 246) | 368 | 410 |
| R11723_1_T7 (SEQ ID NO: 238) | 368 | 410 |
| R11723_1_T8 (SEQ ID NO: 239) | 368 | 410 |
| R11723_1_T9 (SEQ ID NO: 240) | 368 | 410 |

Segment cluster R11723_1_N6 (SEQ ID NO:258) according to the present invention is supported by 39 libraries. The number of libraries was determined as previously described. This segment can be found in the following transcript(s): R11723_1_T12 (SEQ ID NO:243), R11723_1_T13 (SEQ ID NO:244), R11723_1_T14 (SEQ ID NO:245), R11723_1_T15 (SEQ ID NO:246), R11723_1_T7 (SEQ ID NO:238), R11723_1_T8 (SEQ ID NO:239) and R11723_1_T9 (SEQ ID NO:240). Table 326 below describes the starting and ending position of this segment on each transcript.

TABLE 326

Segment location on transcripts

| Transcript name | Segment starting position | Segment ending position |
|---|---|---|
| R11723_1_T12 (SEQ ID NO: 243) | 411 | 442 |
| R11723_1_T13 (SEQ ID NO: 244) | 411 | 442 |
| R11723_1_T14 (SEQ ID NO: 245) | 411 | 442 |
| R11723_1_T15 (SEQ ID NO: 246) | 411 | 442 |
| R11723_1_T7 (SEQ ID NO: 238) | 411 | 442 |
| R11723_1_T8 (SEQ ID NO: 239) | 411 | 442 |
| R11723_1_T9 (SEQ ID NO: 240) | 411 | 442 |

Segment cluster R11723_1_N7 (SEQ ID NO:259) according to the present invention is supported by 42 libraries. The number of libraries was determined as previously described. This segment can be found in the following transcript(s): R11723_1_T12 (SEQ ID NO:243), R11723_1_T13 (SEQ ID NO:244), R11723_1_T14 (SEQ ID NO:245), R11723_1_T15 (SEQ ID NO:246), R11723_1_T7 (SEQ ID NO:238), R11723_1_T8 (SEQ ID NO:239) and R11723_1_T9 (SEQ ID NO:240). Table 327 below describes the starting and ending position of this segment on each transcript.

TABLE 327

Segment location on transcripts

| Transcript name | Segment starting position | Segment ending position |
|---|---|---|
| R11723_1_T12 (SEQ ID NO: 243) | 443 | 481 |
| R11723_1_T13 (SEQ ID NO: 244) | 443 | 481 |
| R11723_1_T14 (SEQ ID NO: 245) | 443 | 481 |
| R11723_1_T15 (SEQ ID NO: 246) | 443 | 481 |
| R11723_1_T7 (SEQ ID NO: 238) | 443 | 481 |
| R11723_1_T8 (SEQ ID NO: 239) | 443 | 481 |
| R11723_1_T9 (SEQ ID NO: 240) | 443 | 481 |

Segment cluster R11723_1_N8 (SEQ ID NO:260) according to the present invention is supported by 6 libraries. The number of libraries was determined as previously described. This segment can be found in the following transcript(s): R11723_1_T12 (SEQ ID NO:243) and R11723_1_T8 (SEQ ID NO:239). Table 328 below describes the starting and ending position of this segment on each transcript.

TABLE 328

Segment location on transcripts

| Transcript name | Segment starting position | Segment ending position |
|---|---|---|
| R11723_1_T12 (SEQ ID NO: 243) | 482 | 515 |
| R11723_1_T8 (SEQ ID NO: 239) | 482 | 515 |

Segment cluster R11723_1_N10 (SEQ ID NO:261) according to the present invention is supported by 1 libraries. The number of libraries was determined as previously described. This segment can be found in the following transcript(s): R11723_1_T11 (SEQ ID NO:242). Table 329 below describes the starting and ending position of this segment on each transcript.

TABLE 329

Segment location on transcripts

| Transcript name | Segment starting position | Segment ending position |
|---|---|---|
| R11723_1_T11 (SEQ ID NO: 242) | 1 | 27 |

Segment cluster R11723_1_N11 (SEQ ID NO:262) according to the present invention is supported by 51 libraries. The number of libraries was determined as previously described. This segment can be found in the following transcript(s): R11723_1_T10 (SEQ ID NO:241), R11723_1_T11 (SEQ ID NO:242), R11723_1_T12 (SEQ ID NO:243), R11723_1_T13 (SEQ ID NO:244), R11723_1_T14 (SEQ ID NO:245), R11723_1_T15 (SEQ ID NO:246), R11723_1_T7 (SEQ ID NO:238), R11723_1_T8 (SEQ ID NO:239) and R11723_1_T9 (SEQ ID NO:240). Table 330 below describes the starting and ending position of this segment on each transcript.

TABLE 330

Segment location on transcripts

| Transcript name | Segment starting position | Segment ending position |
|---|---|---|
| R11723_1_T10 (SEQ ID NO: 241) | 320 | 363 |
| R11723_1_T11 (SEQ ID NO: 242) | 28 | 71 |
| R11723_1_T12 (SEQ ID NO: 243) | 516 | 559 |
| R11723_1_T13 (SEQ ID NO: 244) | 482 | 525 |
| R11723_1_T14 (SEQ ID NO: 245) | 482 | 525 |
| R11723_1_T15 (SEQ ID NO: 246) | 482 | 525 |
| R11723_1_T7 (SEQ ID NO: 238) | 482 | 525 |
| R11723_1_T8 (SEQ ID NO: 239) | 516 | 559 |
| R11723_1_T9 (SEQ ID NO: 240) | 482 | 525 |

Segment cluster R11723_1_N12 (SEQ ID NO:263) according to the present invention is supported by 56 libraries. The number of libraries was determined as previously described. This segment can be found in the following transcript(s): R11723_1_T10 (SEQ ID NO:241), R11723_1_T11 (SEQ ID NO:242), R11723_1_T12 (SEQ ID NO:243), R11723_1_T13 (SEQ ID NO:244), R11723_1_T14 (SEQ ID NO:245), R11723_1_T15 (SEQ ID NO:246), R11723_1_T7 (SEQ ID NO:238), R11723_1_T8 (SEQ ID NO:239) and R11723_1_T9 (SEQ ID NO:240).

Table 331 below describes the starting and ending position of this segment on each transcript.

TABLE 331

Segment location on transcripts

| Transcript name | Segment starting position | Segment ending position |
|---|---|---|
| R11723_1_T10 (SEQ ID NO: 241) | 364 | 457 |
| R11723_1_T11 (SEQ ID NO: 242) | 72 | 165 |
| R11723_1_T12 (SEQ ID NO: 243) | 560 | 653 |
| R11723_1_T13 (SEQ ID NO: 244) | 526 | 619 |
| R11723_1_T14 (SEQ ID NO: 245) | 526 | 619 |
| R11723_1_T15 (SEQ ID NO: 246) | 526 | 619 |
| R11723_1_T7 (SEQ ID NO: 238) | 526 | 619 |
| R11723_1_T8 (SEQ ID NO: 239) | 560 | 653 |
| R11723_1_T9 (SEQ ID NO: 240) | 526 | 619 |

Segment cluster R11723_1_N16 (SEQ ID NO:264) according to the present invention is supported by 1 libraries. The number of libraries was determined as previously described. This segment can be found in the following transcript(s): R11723_1_T15 (SEQ ID NO:246). Table 332 below describes the starting and ending position of this segment on each transcript.

TABLE 332

Segment location on transcripts

| Transcript name | Segment starting position | Segment ending position |
|---|---|---|
| R11723_1_T15 (SEQ ID NO: 246) | 620 | 623 |

Segment cluster R11723_1_N19 (SEQ ID NO:265) according to the present invention is supported by 53 libraries. The number of libraries was determined as previously described. This segment can be found in the following transcript(s): R11723_1_T10 (SEQ ID NO:241), R11723_1_T11 (SEQ ID NO:242), R11723_1_T12 (SEQ ID NO:243), R11723_1_T7 (SEQ ID NO:238), R11723_1_T8 (SEQ ID NO:239) and R11723_1_T9 (SEQ ID NO:240). Table 333 below describes the starting and ending position of this segment on each transcript.

TABLE 333

Segment location on transcripts

| Transcript name | Segment starting position | Segment ending position |
|---|---|---|
| R11723_1_T10 (SEQ ID NO: 241) | 458 | 515 |
| R11723_1_T11 (SEQ ID NO: 242) | 166 | 223 |
| R11723_1_T12 (SEQ ID NO: 243) | 807 | 864 |
| R11723_1_T7 (SEQ ID NO: 238) | 620 | 677 |
| R11723_1_T8 (SEQ ID NO: 239) | 654 | 711 |
| R11723_1_T9 (SEQ ID NO: 240) | 773 | 830 |

Segment cluster R11723_1_N21 (SEQ ID NO:266) according to the present invention is supported by 41 libraries. The number of libraries was determined as previously described. This segment can be found in the following transcript(s): R11723_1_T10 (SEQ ID NO:241), R11723_1_T11 (SEQ ID NO:242), R11723_1_T12 (SEQ ID NO:243), R11723_1_T8 (SEQ ID NO:239) and R11723_1_T9 (SEQ ID NO:240). Table 334 below describes the starting and ending position of this segment on each transcript.

TABLE 334

Segment location on transcripts

| Transcript name | Segment starting position | Segment ending position |
|---|---|---|
| R11723_1_T10 (SEQ ID NO: 241) | 690 | 700 |
| R11723_1_T11 (SEQ ID NO: 242) | 398 | 408 |
| R11723_1_T12 (SEQ ID NO: 243) | 1039 | 1049 |
| R11723_1_T8 (SEQ ID NO: 239) | 886 | 896 |
| R11723_1_T9 (SEQ ID NO: 240) | 1005 | 1015 |

Segment cluster R11723_1_N22 (SEQ ID NO:267) according to the present invention is supported by 40 libraries. The number of libraries was determined as previously described. This segment can be found in the following transcript(s): R11723_1_T10 (SEQ ID NO:241), R11723_1_T11 (SEQ ID NO:242), R11723_1_T12 (SEQ ID NO:243), R11723_1_T8 (SEQ ID NO:239) and R11723_1_T9 (SEQ ID NO:240). Table 335 below describes the starting and ending position of this segment on each transcript.

TABLE 335

Segment location on transcripts

| Transcript name | Segment starting position | Segment ending position |
|---|---|---|
| R11723_1_T10 (SEQ ID NO: 241) | 701 | 763 |
| R11723_1_T11 (SEQ ID NO: 242) | 409 | 471 |
| R11723_1_T12 (SEQ ID NO: 243) | 1050 | 1112 |
| R11723_1_T8 (SEQ ID NO: 239) | 897 | 959 |
| R11723_1_T9 (SEQ ID NO: 240) | 1016 | 1078 |

Segment cluster R11723_1_N24 (SEQ ID NO:268) according to the present invention is supported by 11 libraries. The number of libraries was determined as previously described. This segment can be found in the following transcript(s): R11723_1_T10 (SEQ ID NO:241), R11723_1_T11 (SEQ ID NO:242), R11723_1_T12 (SEQ ID NO:243), R11723_1_T8 (SEQ ID NO:239) and R11723_1_T9 (SEQ ID NO:240). Table 336 below describes the starting and ending position of this segment on each transcript.

TABLE 336

Segment location on transcripts

| Transcript name | Segment starting position | Segment ending position |
|---|---|---|
| R11723_1_T10 (SEQ ID NO: 241) | 1251 | 1280 |
| R11723_1_T11 (SEQ ID NO: 242) | 959 | 988 |
| R11723_1_T12 (SEQ ID NO: 243) | 1600 | 1629 |
| R11723_1_T8 (SEQ ID NO: 239) | 1447 | 1476 |
| R11723_1_T9 (SEQ ID NO: 240) | 1566 | 1595 |

Segment cluster R11723_1_N26 (SEQ ID NO:269) according to the present invention is supported by 9 libraries. The number of libraries was determined as previously described. This segment can be found in the following transcript(s): R11723_1_T10 (SEQ ID NO:241), R11723_1_T11 (SEQ ID NO:242), R11723_1_T12 (SEQ ID NO:243), R11723_1_T7 (SEQ ID NO:238), R11723_1_T8 (SEQ ID NO:239) and R11723_1_T9 (SEQ ID NO:240). Table 337 below describes the starting and ending position of this segment on each transcript.

TABLE 337

Segment location on transcripts

| Transcript name | Segment starting position | Segment ending position |
|---|---|---|
| R11723_1_T10 (SEQ ID NO: 241) | 1610 | 1658 |
| R11723_1_T11 (SEQ ID NO: 242) | 1318 | 1366 |
| R11723_1_T12 (SEQ ID NO: 243) | 1959 | 2007 |
| R11723_1_T7 (SEQ ID NO: 238) | 1007 | 1055 |
| R11723_1_T8 (SEQ ID NO: 239) | 1806 | 1854 |
| R11723_1_T9 (SEQ ID NO: 240) | 1925 | 1973 |

The alignment of R11723 variant proteins to the previously known proteins is shown in the attached CD-Rom.

Expression of R11723 Transcripts, which were Detectable by Amplicon as Depicted in Sequence R11723 junc11-18 (SEQ ID NO:496) in Normal and Cancerous Ovary Tissues:

Expression of transcripts detectable by or according to junc11-18 R11723 junc11-18 (SEQ ID NO:496)amplicon and R11723 junc11-18F (SEQ ID NO:494) and R1172 junc11-18R (SEQ ID NO:495) primers was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), SDHA (GenBank Accession No. NM_004168 (SEQ ID NO:462); amplicon—SDHA-amplicon (SEQ ID NO:465)), and GAPDH (GenBank Accession No. BC026907 (SEQ ID NO:438); GAPDH amplicon (SEQ ID NO:441)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos 45,46,48, 71, Table 2_2, above), to obtain a value of fold up-regulation for each sample relative to median of the normal PM samples.

Figure 24:
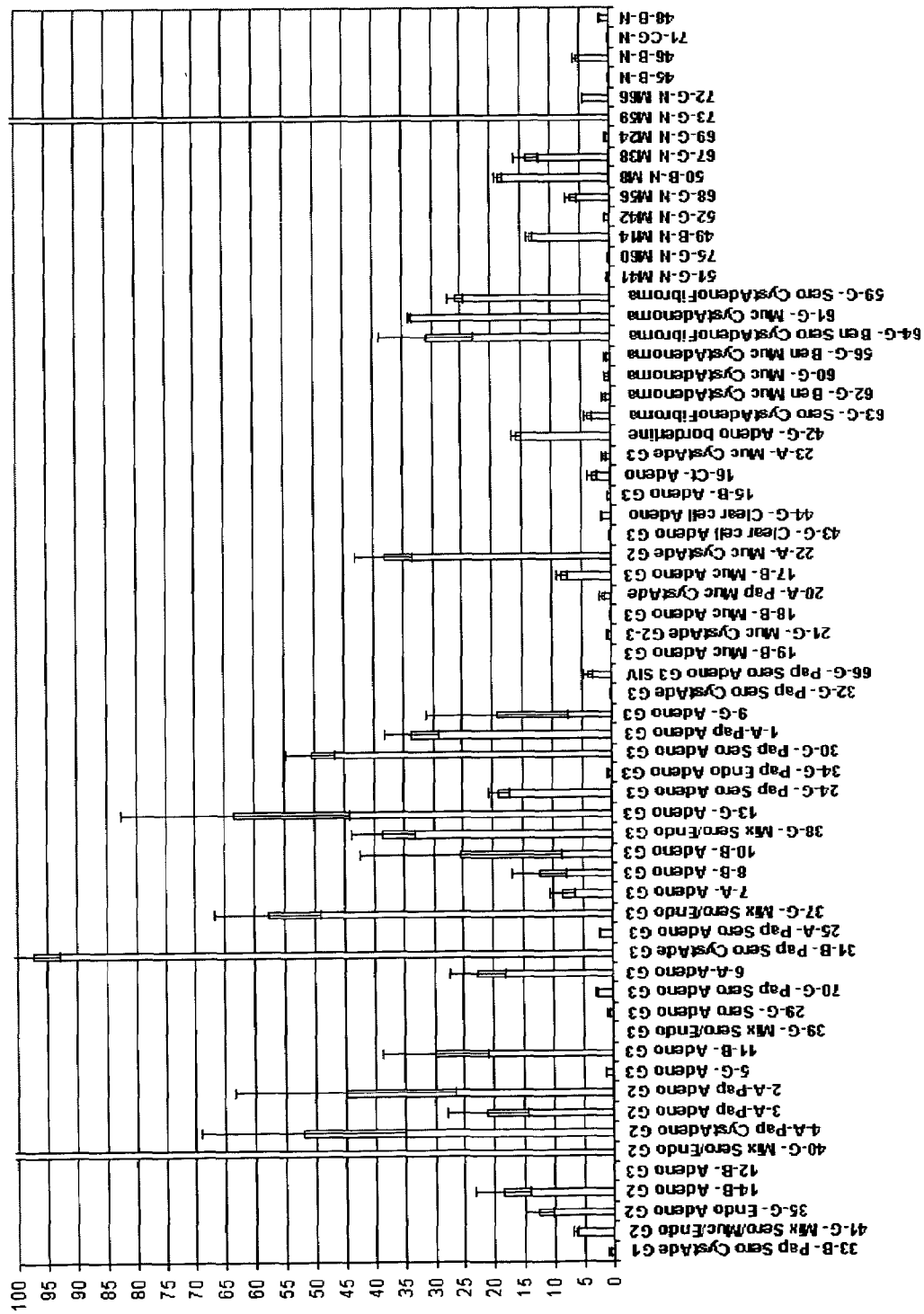
FIG. 24 is a histogram showing expression of R11723 transcripts, which are detectable by amplicon as depicted in sequence R11723 junc11-18 (SEQ ID NO:496) (SEQ ID NO:496) in normal and cancerous ovary tissues.

FIG. 24 is a histogram showing over expression of the above-indicated transcripts in cancerous ovary samples relative to the normal samples. Values represent the average of duplicate experiments. Error bars indicate the minimal and maximal values obtained.

As is evident from FIG. 24, the expression of transcripts detectable by the above amplicon in cancer samples was significantly higher than in the non-cancerous samples (Sample Nos 45-48, 71 Table 2_2). Notably an over-expression of at least 5 fold was found in 23 out of 43 adenocarcinoma samples. Statistical analysis was applied to verify the significance of these results as follows: the P value for the difference in the expression levels of the transcripts detectable by the above amplicon in ovary cancer samples versus the normal tissue samples was determined by T test as 5.4E-04. This value demonstrate statistical significance of the results. Primer pairs are also optionally and preferably encompassed within the present invention; for example, for the above experiment, the following primer pair was used as a non-limiting illustrative example only of a suitable primer pair R11723 junc11-18F (SEQ ID NO:494) forward primer; and R11723 junc11-18R (SEQ ID NO:495) reverse primer.

The present invention also preferably encompasses any amplicon obtained through the use of any suitable primer pair; for example, for the above experiment, the following amplicon was obtained as a non-limiting illustrative example only of a suitable amplicon: R11723 junc11-18 (SEQ ID NO:496)

R11723junc11-18F (SEQ ID NO:494)—AGTGATG-GAGCAAAGTGCCGR11723 junc11-18R (SEQ ID NO:495)—CAGCAGCTGATGCAAACTGAG R11723 junc11-18 (SEQ ID NO:496)—AGTGATG-GAGCAAAGTGCCGGGATCATGTACCG-CAAGTCCTGTGCATCATCAGCGGC CTGTCT-CATCGCCTCTGCCGGGTACCAGTCCTTCTGCTC CCCAGGGAAACTGAACTCA GTTTGCATCAGCT-GCTG Expression of R11723 Transcripts, Which were Detected by Amplicon as Depicted in the Sequence Name R11723 junc11-18 (SEQ ID NO:496) in Different Normal Tissues:

Expression of R11723 transcripts detectable by or according to R11723seg11-18 amplicon and R11723 junc11-18F (SEQ ID NO:494), R11723 junc11-18R (SEQ ID NO:495) was measured by real time PCR. In parallel the expression of four housekeeping genes RPL19 (GenBank Accession No. NM_000981 (SEQ ID NO:450); RPL19 amplicon (SEQ ID NO:453)), TATA box (GenBank Accession No. NM_003194 (SEQ ID NO:454); TATA amplicon (SEQ ID NO:457)), UBC (GenBank Accession No. BC000449 (SEQ ID NO:458); amplicon—Ubiquitin-amplicon (SEQ ID NO:461)) and SDHA (GenBank Accession No. NM_004168 (SEQ ID NO:462); amplicon—SDHA-amplicon (SEQ ID NO:465)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 19-20 Table 2_6 above), to obtain a value of relative expression of each sample relative to median of the ovary samples.

Figure 25:
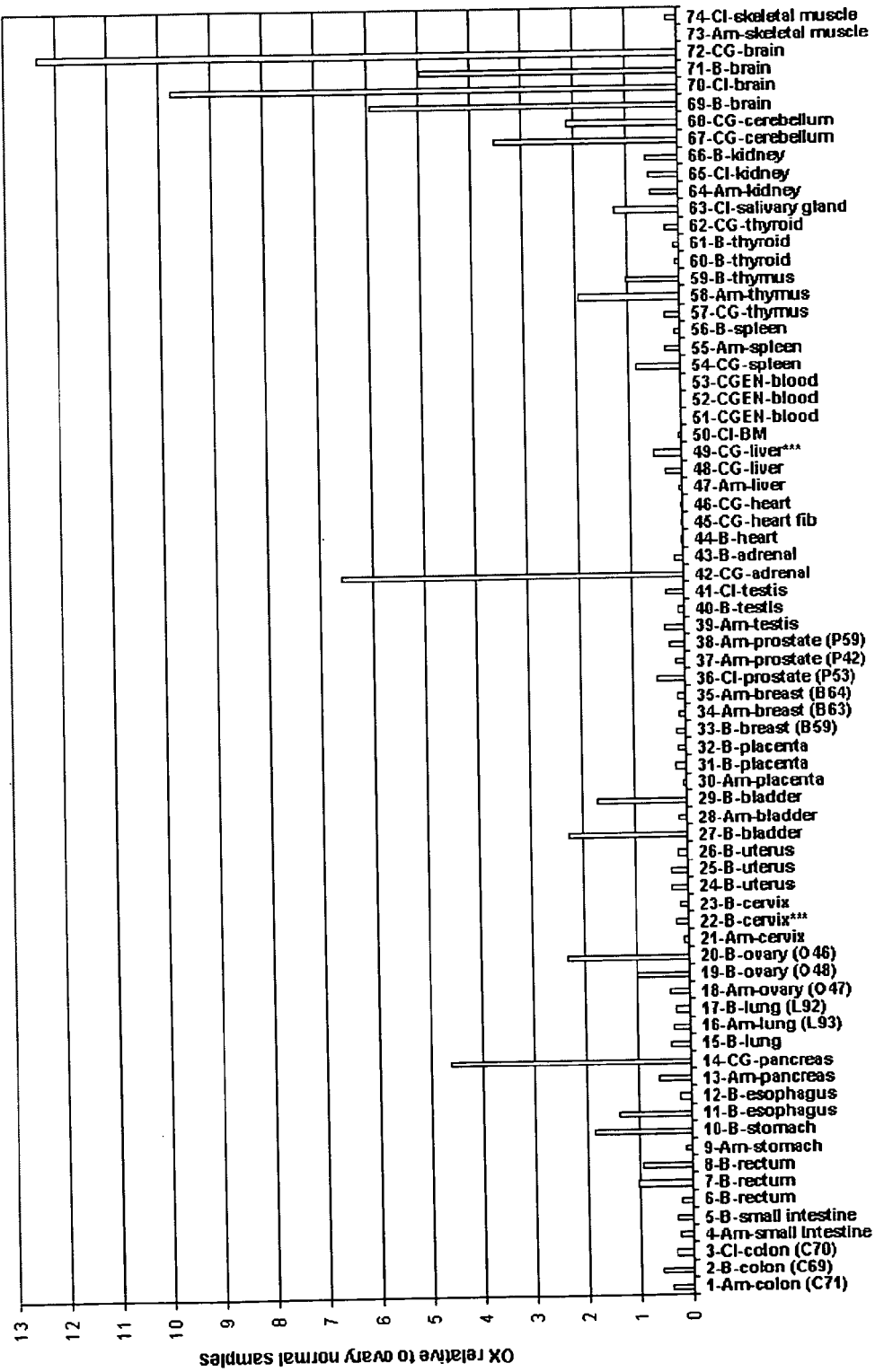
FIG. 25 is a histogram showing expression of R11723 transcripts, which are detectable by amplicon as depicted in sequence R11723 junc11-18 (SEQ ID NO:496) (SEQ ID NO:496) in different normal tissues.

FIG. 25 is a histogram showing expression of R11723 transcripts, which are detectable by amplicon as depicted in sequence R11723 junc11-18 (SEQ ID NO:496) in different normal tissues.

```
Primers:
R11723junc11-18F (SEQ D NO: 494)-
AGTGATGGAGCAAAGTGCCG

R11723 junc11-18R (SEQ ID NO: 495)-
CAGCAGCTGATGCAAACTGAG

R11723 junc11-18 (SEQ ID NO: 496)-
amplicon
AGTGATGGAGCAAAGTGCCGGGATCATGTACCGCAAGTCCTGTGCATCATCAGCGGC

CTGTCTCATCGCCTCTGCCGGGTACCAGTCCTTCTGCTCCCCAGGGAAACTGAACTCA

GTTTGCATCAGCTGCTG
```

Expression of R11723 Transcripts Which are Detectable by Amplicon as Depicted in Sequence Name R11723 seg13 (SEQ ID NO:499) in Normal and Cancerous Colon Tissues:

Expression of transcripts detectable by or according to seg13, R11723 seg13 (SEQ ID NO:499) amplicon and R11723 seg13F (SEQ ID NO:497) and R11723 seg13R (SEQ ID NO:498) primers was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), G6PD (GenBank Accession No. NM_000402 (SEQ ID NO:442); G6PD amplicon (SEQ ID NO:445)), RPS27A (GenBank Accession No. NM_002954 (SEQ ID NO:446); RPS27A amplicon (SEQ ID NO:446)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 41, 52, 62-67, 69-71, Table 2_3, above), to obtain a value of fold differential expression for each sample relative to median of the normal PM samples.

Figure 26:
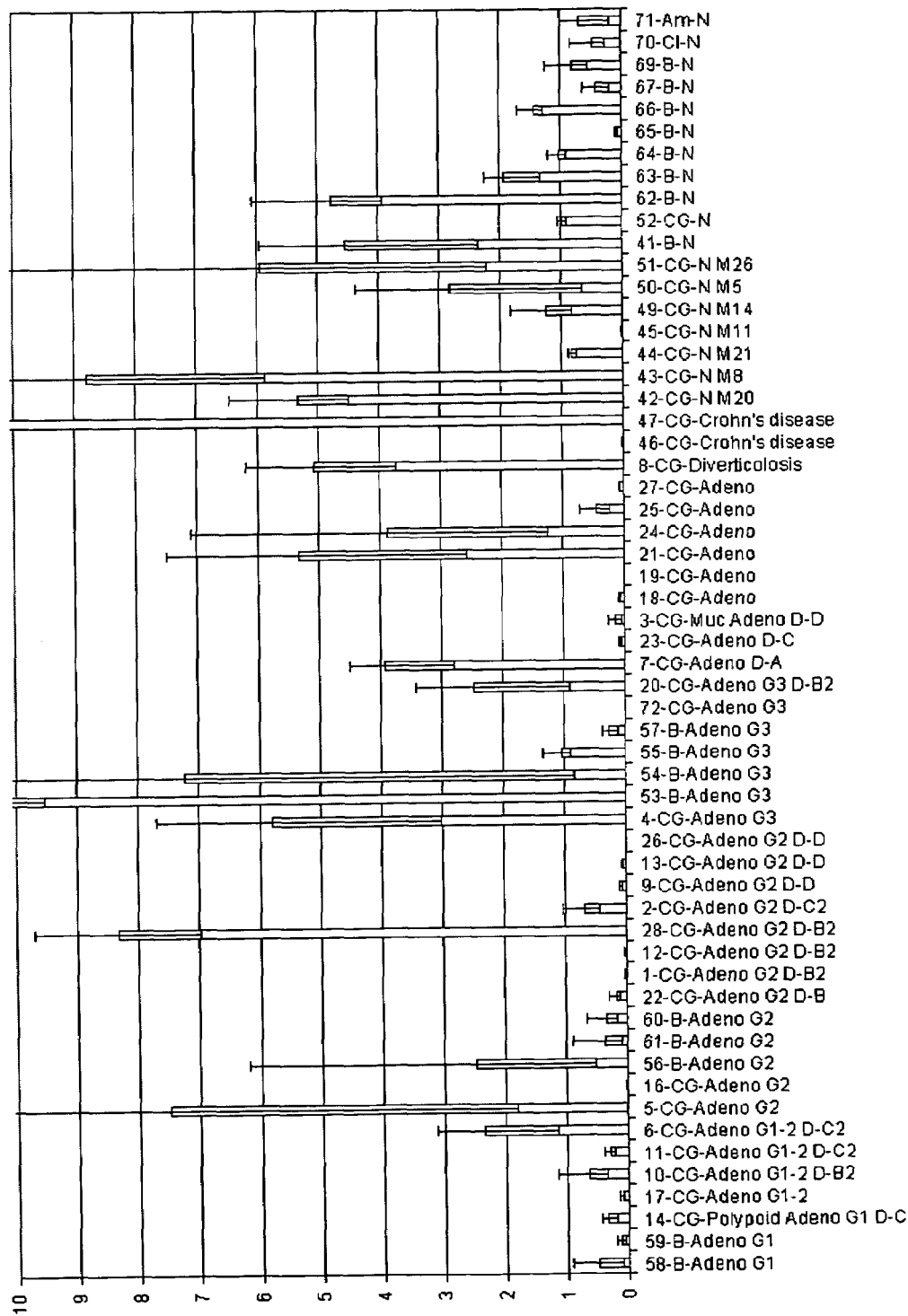
FIG. 26 is a histogram showing expression of R11723 transcripts, which are detectable by amplicon as depicted in sequence R11723seg13 (SEQ ID NO:499) in normal and cancerous colon tissues.

FIG. 26 is a histogram showing down regulation of the above-indicated transcripts in cancerous colon samples relative to the normal samples. Values represent the average of triplicate experiments. Error bars indicate the minimal and maximal values obtained As is evident from FIG. 26, the expression of transcripts detectable by the above amplicon in cancer samples was lower in several cancerous samples and higher in a few other cancerous samples, than in the non-cancerous samples (Sample Nos. 41, 52, 62-67, 69-71 Table 2_3).

Primer pairs are also optionally and preferably encompassed within the present invention; for example, for the above experiment, the following primer pair was used as a non-limiting illustrative example only of a suitable primer pair: R11723 seg13F (SEQ ID NO:497) forward primer; and R11723 seg13R (SEQ ID NO:498) reverse primer.

The present invention also preferably encompasses any amplicon obtained through the use of any suitable primer pair; for example, for the above experiment, the following amplicon was obtained as a non-limiting illustrative example only of a suitable amplicon: R11723 seg13 (SEQ ID NO:499).

R11723seg13F (SEQ ID NO:497)—ACACTAAAAGAA-CAAACACCTTGCTC

R11723seg13R (SEQ ID NO:498)—TCCTCAGAAGGCA-CATGAAAGA

R11723seg13 (SEQ ID NO:499)—amplicon:
ACACTAAAAGAACAAACACCTTGCTCT-
TCGAGATGAGACATTTTGCCAAGCAGTTGA
CCACTTAGTTCTCAAGAAGCAAC-
TATCTCTTTCATGTGCCTTCTGAGGA The conversion of the R11723seg13 (SEQ ID NO:499) name to the currently available sequence version, as listed in Table 291, is as follows: R11723_1 seg14.

Expression of R11723 Transcripts Which are Detectable by Amplicon as Depicted in Sequence Name R11723 seg13 (SEQ ID NO:499) in Normal and Cancerous Breast Tissues:

Expression of transcripts detectable by or according to seg13, R11723 seg13 (SEQ ID NO:499) amplicon and R11723 seg13F (SEQ ID NO:497) and R11723 seg13R (SEQ ID NO:498) primers was measured by real time PCR. In parallel the expression of four housekeeping genes PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), and SDHA (GenBank Accession No. NM_004168 (SEQ ID NO:462); amplicon—SDHA-amplicon (SEQ ID NO:465)), G6PD (GenBank Accession No. NM_000402 (SEQ ID NO:442); G6PD amplicon (SEQ ID NO:445)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 2_5, above), to obtain a value of fold up-regulation for each sample relative to median of the normal PM samples.

Figure 27:
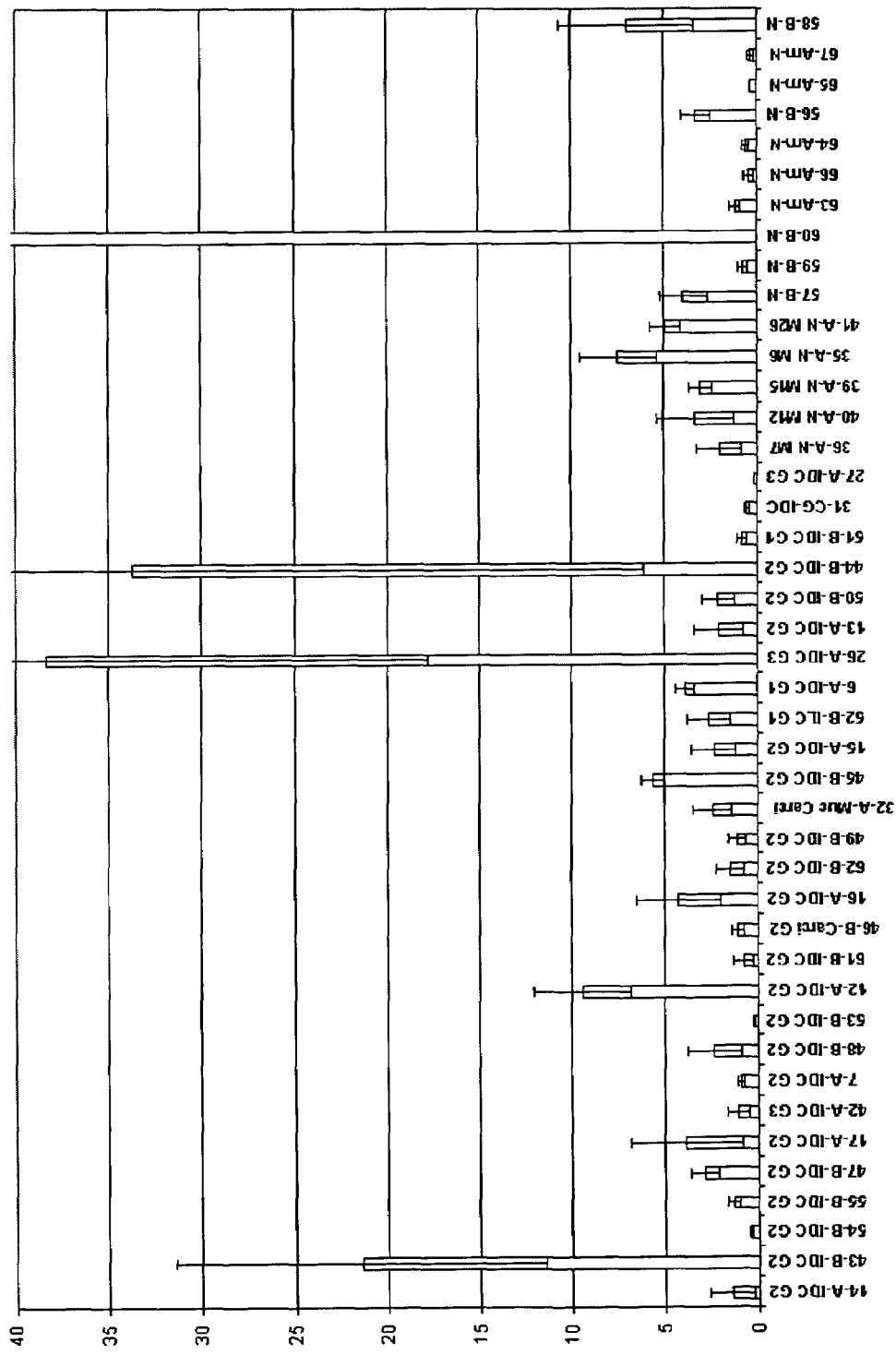
FIG. 27 is a histogram showing expression of R11723 transcripts, which are detectable by amplicon as depicted in sequence R11723seg13 (SEQ ID NO:499) in normal and cancerous breast tissues.

FIG. 27 is a histogram showing over expression of the above-indicated transcripts in cancerous breast samples relative to the normal samples. Values represent the average of triplicate experiments. Error bars indicate the minimal and maximal values obtained.

As is evident from FIG. 27, the expression of transcripts detectable by the above amplicon in cancer samples was higher in a few cancerous samples than in the non-cancerous samples (Sample Nos. 56-60, 63-67 Table 2_5). Notably an over-expression of at least 5 fold was found in 5 out of 28 adenocarcinoma samples.

Primer pairs are also optionally and preferably encompassed within the present invention; for example, for the above experiment, the following primer pair was used as a non-limiting illustrative example only of a suitable primer pair: R11723 seg13F (SEQ ID NO:497) forward primer; and R11723 seg13R (SEQ ID NO:498) reverse primer.

The present invention also preferably encompasses any amplicon obtained through the use of any suitable primer pair; for example, for the above experiment, the following amplicon was obtained as a non-limiting illustrative example only of a suitable amplicon: R11723 seg13 (SEQ ID NO:499).

R11723seg13F (SEQ ID NO:497)—ACACTAAAAGAA-CAAACACCTTGCTC

R11723seg13R (SEQ ID NO:498)—TCCTCAGAAGGCA-CATGAAAGA

R11723seg13 (SEQ ID NO:499)—amplicon:
ACACTAAAAGAACAAACACCTTGCTCT-
TCGAGATGAGACATTTTGCCAAGCAGTTGA
CCACTTAGTTCTCAAGAAGCAAC-
TATCTCTTTCATGTGCCTTCTGAGGA The conversion of the R11723seg13 (SEQ ID NO:499) name to the currently available sequence version, as listed in Table 291, is as follows: R11723_1 seg14.

Expression of R11723 Transcripts Which are Detectable by Amplicon as Depicted in Sequence Name R11723 seg13 (SEQ ID NO:499) in Normal and cancerous Lung Tissues:

Expression of transcripts detectable by or according to seg13, R11723 seg13 (SEQ ID NO:499) amplicon and R11723 seg13F (SEQ ID NO:497) and R11723 seg13R (SEQ ID NO:498) primers was measured by real time PCR. In parallel the expression of four housekeeping genes PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), and SDHA (GenBank Accession No. NM_004168 (SEQ ID NO:462); amplicon—SDHA-amplicon (SEQ ID NO:465)), Ubiquitin (GenBank Accession No. BC000449 (SEQ ID NO:458); amplicon—Ubiquitin-amplicon (SEQ ID NO:461)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2_4, above), to obtain a value of fold up-regulation for each sample relative to median of the normal PM samples.

Figure 28:
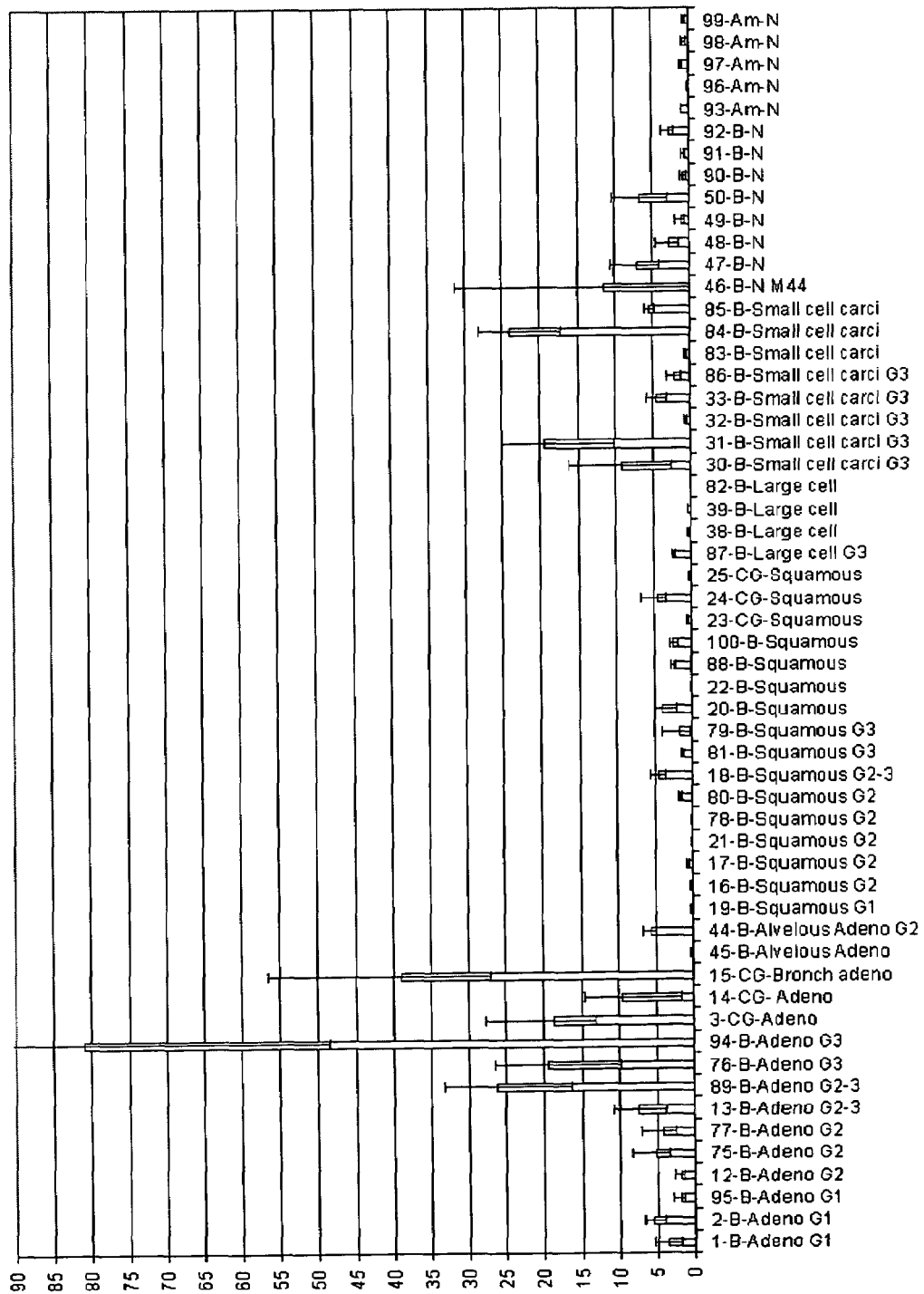
FIG. 28 is a histogram showing expression of R11723 transcripts, which are detectable by amplicon as depicted in sequence R11723seg13 (SEQ ID NO:499) in normal and cancerous lung tissues.

FIG. 28 is a histogram showing over expression of the above-indicated transcripts in cancerous lung samples relative to the normal samples. Values represent the average of triplicate experiments. Error bars indicate the minimal and maximal values obtained As is evident from FIG. 28, the expression of transcripts detectable by the above amplicon in cancer samples was higher than in the non-cancerous samples (Sample Nos. 47-50, 90-93, 96-99, Table 2_4). Notably an over-expression of at least 7 fold was found in 7 out of 15 adenocarcinoma samples, and in 3 out of 8 small cells carcinoma samples.

Statistical analysis was applied to verify the significance of these results, as described below.

The P value for the difference in the expression levels of transcripts detectable by the above amplicon in adenocarcinoma lung cancer samples versus the normal tissue samples was determined by T test as 3.1E-02. Threshold of 7 fold overexpression was found to differentiate between adeonocarcinoma and normal samples with P value of 3.77E-02. The above values demonstrate statistical significance of the results. Primer pairs are also optionally and preferably encompassed within the present invention; for example, for the above experiment, the following primer pair was used as a non-limiting illustrative example only of a suitable primer pair: R11723 seg13F (SEQ ID NO:497) forward primer; and R11723 seg13R (SEQ ID NO:498) reverse primer.

The present invention also preferably encompasses any amplicon obtained through the use of any suitable primer pair; for example, for the above experiment, the following amplicon was obtained as a non-limiting illustrative example only of a suitable amplicon: R11723 seg13 (SEQ ID NO:499).

R11723seg13F (SEQ ID NO:497)—ACACTAAAAGAA-CAAACACCTTGCTC

R11723seg13R (SEQ ID NO:498)—TCCTCAGAAGGCA-CATGAAAGA

R111723seg13 (SEQ ID NO:499)—amplicon:
ACACTAAAAGAACAAACACCTTGCTCT-TCGAGATGAGACATTTTGCCAAGCAGTTGA CCACTTAGTTCTCAAGAAGCAAC-TATCTCTTTCATGTGCCTTCTGAGGA The conversion of the R11723seg13 (SEQ ID NO:499) name to the currently available sequence version, as listed in Table 291, is as follows: R11723_1 seg14.

Expression of R11723 Transcripts Which are Detectable by Amplicon as Depicted in Sequence Name R11723seg13 (SEQ ID NO:499) in Different Normal Tissues:

Expression of R11723 transcripts detectable by or according to R11723seg13 (SEQ ID NO:499) amplicon and R11723seg13F (SEQ ID NO:497), R11723seg13R (SEQ ID NO:498) was measured by real time PCR. In parallel the expression of four housekeeping genes RPL19 (GenBank Accession No. NM_000981 (SEQ ID NO:450); RPL19 amplicon (SEQ ID NO:453)), TATA box (GenBank Accession No. NM_003194 (SEQ ID NO:454); TATA amplicon (SEQ ID NO:457)), UBC (GenBank Accession No. BC000449 (SEQ ID NO:458); amplicon—Ubiquitin-amplicon (SEQ ID NO:461)) and SDHA (GenBank Accession No. NM_004168 (SEQ ID NO:462); amplicon—SDHA-amplicon (SEQ ID NO:465)) was measured similarly. For each RT sample, the expression of the above amplicon was normalized to the geometric mean of the quantities of the housekeeping genes. The normalized quantity of each RT sample was then divided by the median of the quantities of the of the ovary samples (Sample Nos. 19,20, Table 2_6), to obtain a value of relative expression of each sample relative to median of the ovary samples.

Figure 29:
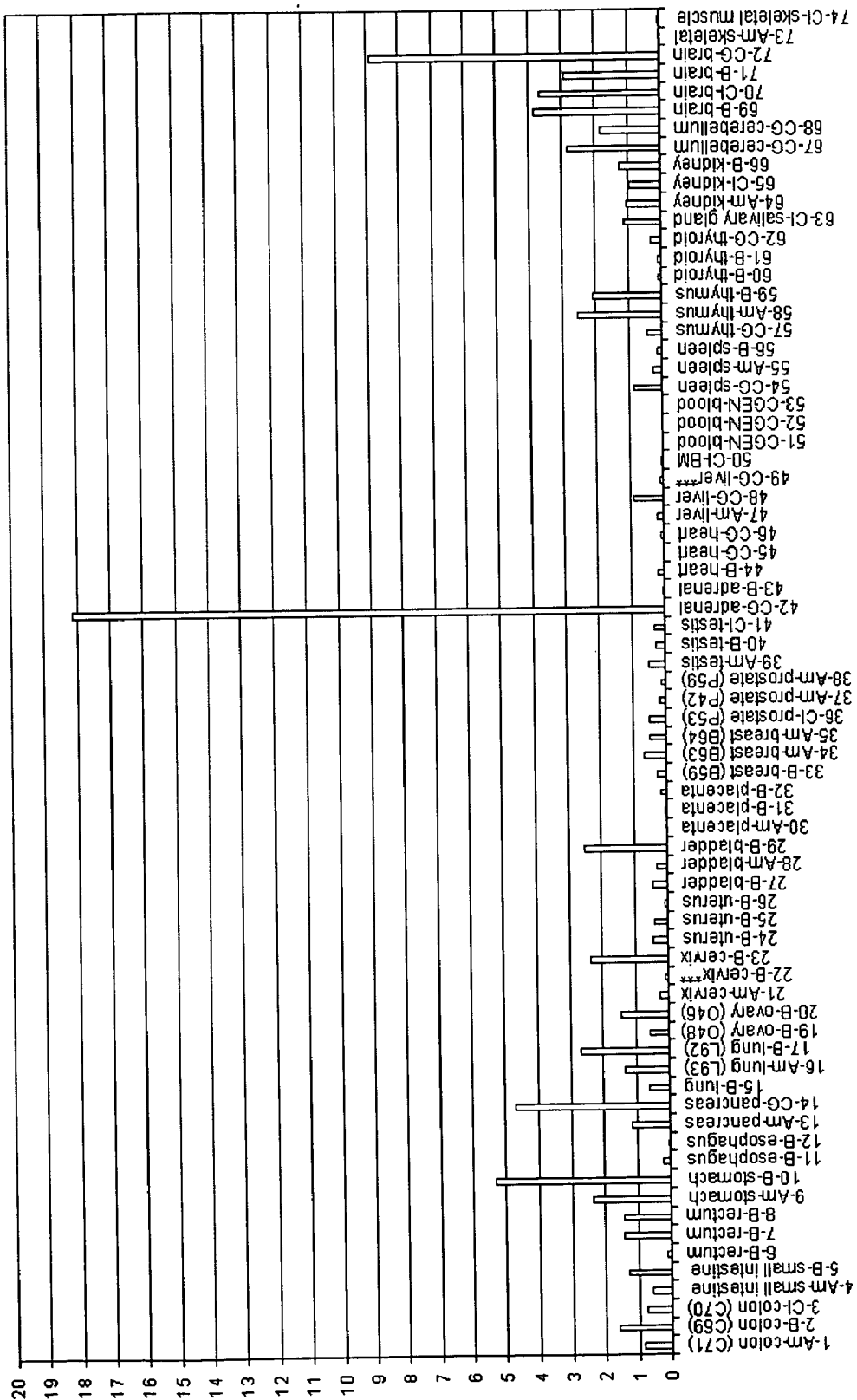
FIG. 29 is a histogram showing expression of R11723 transcripts, which are detectable by amplicon as depicted in sequence R11723seg13 (SEQ ID NO:499) in different normal tissues.

FIG. 29 is a histogram showing expression of R11723 transcripts, which are detectable by amplicon as depicted in sequence R11723seg13 (SEQ ID NO:499) in different normal tissues.

```
Primers:
R11723seg13F (SEQ ID NO: 497)-
ACACTAAAAGAACAAACACCTTGCTC

R11723seg13R (SEQ ID NO: 498)-
TCCTCAGAAGGCACATGAAAGA

R1123seg13 (SEQ ID NO: 499)-
ACACTAAAAGAACAAACACCTTGCTCTTCGAGATGAGACATTTTGCCAAGCAGTTGA

CCACTTAGTTCTCAAGAAGCAACTATCTCTTTCATGTGCCTTCTGAGGA
```

The conversion of the R11723seg13 (SEQ ID NO:499) name to the currently available sequence version, as listed in Table 291, is as follows: R11723_1 seg14.

Expression of R11723 Transcripts Which are Detectable by Amplicon as Depicted in Sequence R11723 seg13 (SEQ ID NO:499) in Normal and Cancerous Ovary Tissues:

Expression of transcripts detectable by or according to seg13, R11723seg13 (SEQ ID NO:499) amplicon(s) and R11723seg13F (SEQ ID NO:497) and R11723seg13R (SEQ ID NO:498) primers was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), and SDHA (GenBank Accession No. NM_004168 (SEQ ID NO:462); amplicon—SDHA-amplicon (SEQ ID NO:465)), GAPDH (GenBank Accession No. BC026907 (SEQ ID NO:438); GAPDH amplicon (SEQ ID NO:441)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos 45,46,-48, 71, Table 2__2, above), to obtain a value of fold up-regulation for each sample relative to median of the normal PM samples.

Figure 30:
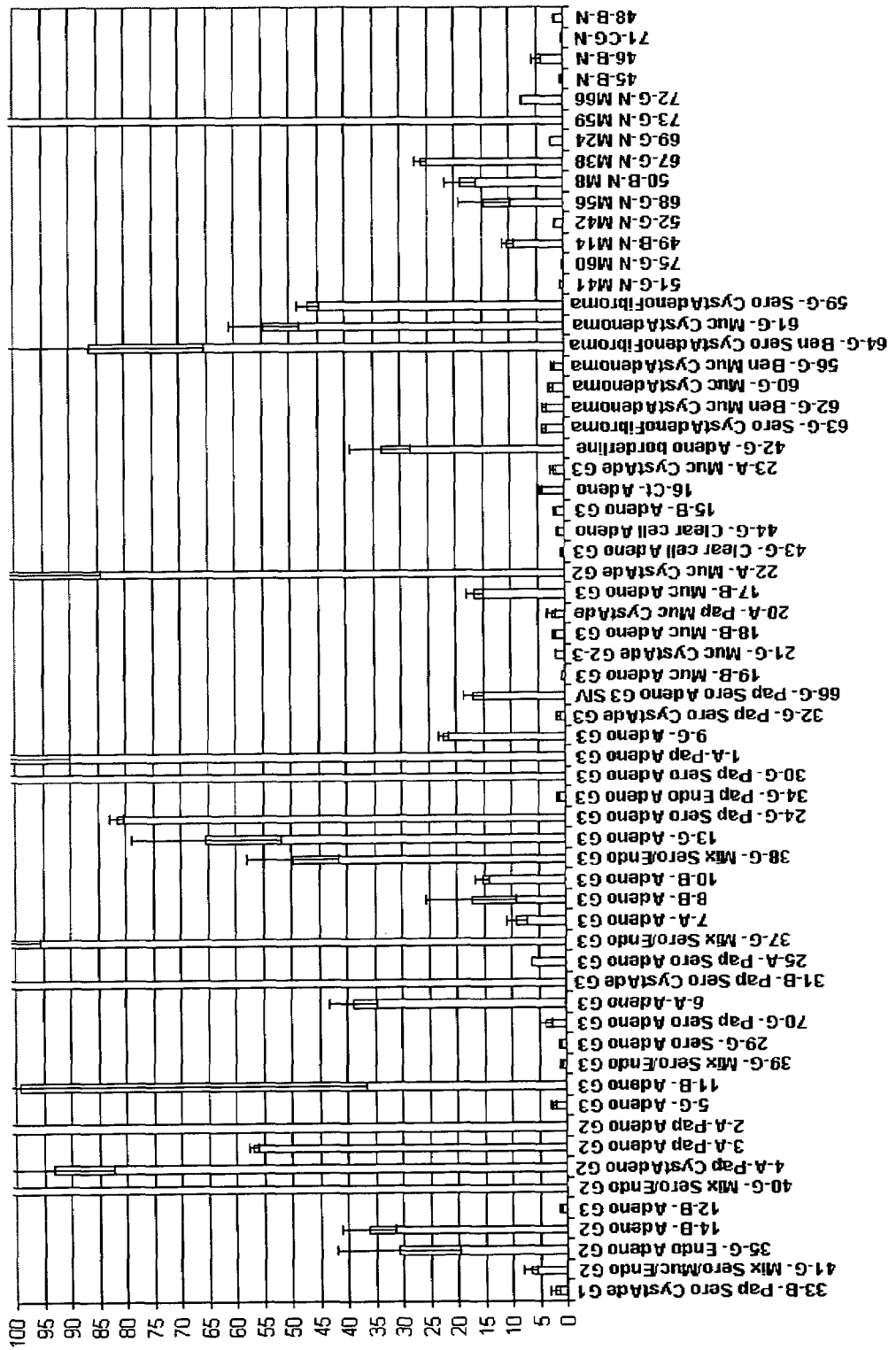
FIG. 30 is a histogram showing expression of R11723 transcripts, which are detectable by amplicon as depicted in sequence R11723seg13 (SEQ ID NO:499) in normal and cancerous ovarian tissues.

FIG. 30 is a histogram showing over expression of the above-indicated transcripts in cancerous ovary samples relative to the normal samples. Values represent the average of duplicate experiments. Error bars indicate the minimal and maximal values obtained As is evident from FIG. 30, the expression of transcripts detectable by the above amplicon(s) in cancer samples was significantly higher than in the non-cancerous samples (Sample Nos: 45,46,48, 71, Table 3, above, Sample Nos: 45-52, , 67-69, 71-75, Table 2__2). Notably an over-expression of at least 5 fold was found in 235 out of 43 adenocarcinoma samples, specifically in 22 out of 30 serous adenocarcinoma samples.

Statistical analysis was applied to verify the significance of these results, as described below.

The P value for the difference in the expression levels of transcripts detectable by the above amplicon(s) in ovary cancer samples versus the normal tissue samples was determined by T test as 1.76E-043.

Threshold of 5 fold overexpression was found to differentiate between cancer and normal samples with P value of 3.41EE-02 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair R11723seg1F forward primer; and R11723seg13R reverse primer.

The present invention also preferably encompasses any amplicon obtained through the use of any suitable primer pair; for example, for the above experiment, the following amplicon was obtained as a non-limiting illustrative example only of a suitable amplicon: R11723seg13 (SEQ ID NO:499)
R11723seg13F (SEQ ID NO:497)—ACACTAAAAGAA-CAAACACCTTGCTC
R11723seg13R (SEQ ID NO:498)—TCCTCAGAAGGCA-CATGAAAGA
R11723seg13 (SEQ ID NO:499)—ACACTAAAAGAA-CAAACACCTTGCTCTTCGAGATGAGA-CATTTTGCCAAGCAGTTGA CCACTTAGTTCTCAA-GAAGCAACTATCTCTTTCATGTGCCTTCTGAGGA The conversion of the R11723seg13 (SEQ ID NO:499) name to the currently available sequence version, as listed in Table 291, is as follows: R11723__1 seg14.

Expression of R11723 Transcripts, Which are Detectable by Amplicon as Depicted in Sequence Name R11723 junc11-18 (SEQ ID NO:496) in Normal and Cancerous Prostate Tissues:

Expression of transcripts detectable by or according to junc11-18 R11723junc11-18 amplicon (SEQ ID NO:496) and R11723junc11-18F (SEQ ID NO:494) and R11723junc11-18R (SEQ ID NO:495) primers was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), SDHA (GenBank Accession No. NM_004168 (SEQ ID NO:462); amplicon—SDHA-amplicon (SEQ ID NO:465)), and RPL19 (GenBank Accession No. NM_000981 (SEQ ID NO:450); RPL19 amplicon (SEQ ID NO:453)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 42, 48-53, 59-63 Table 2__1, above), to obtain a value of fold up-regulation for each sample relative to median of the normal PM samples.

Figure 31:
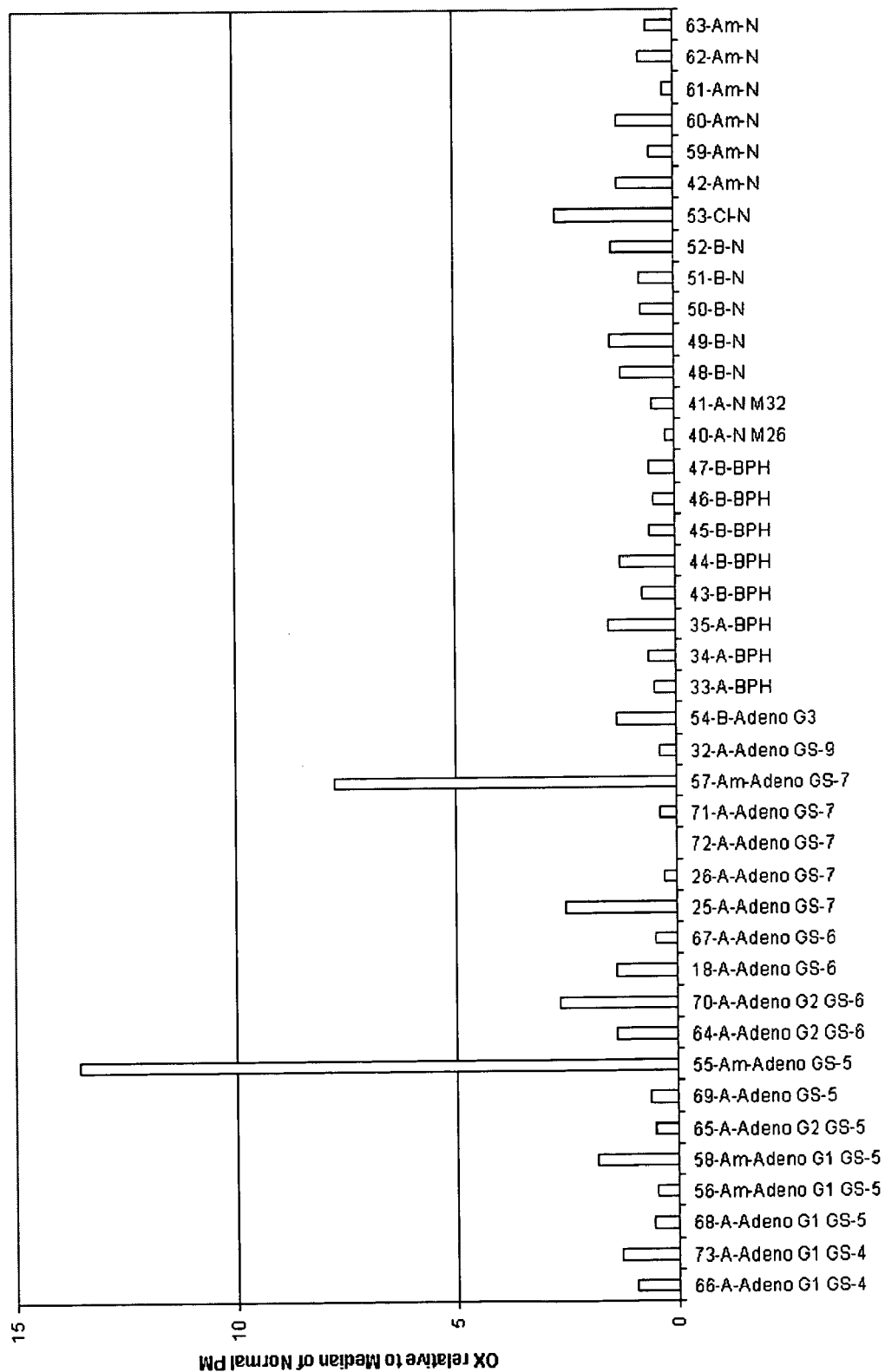
FIG. 31 is a histogram showing expression of R11723 transcripts, which are detectable by amplicon as depicted in sequence R11723 junc11-18 (SEQ ID NO:496) in normal and cancerous prostate tissues.

FIG. 31 is a histogram showing expression of the above-indicated transcripts in cancerous prostate samples relative to the normal samples.

As is evident from FIG. 31, the expression of transcripts detectable by the above amplicon in a few cancer samples was higher than in the non-cancerous samples (Sample Nos. 42, 48-53, 59-63, Table 2__1, above). Notably an over-expression of at least 5 fold was found in 2 out of 19 adenocarcinoma samples Primer pairs are also optionally and preferably encompassed within the present invention; for example, for the above experiment, the following primer pair was used as a non-limiting illustrative example only of a suitable primer pair: R11723junc11-18F (SEQ ID NO:494) forward primer; and R11723 junc11-18R (SEQ ID NO:495) reverse primer.

The present invention also preferably encompasses any amplicon obtained through the use of any suitable primer pair; for example, for the above experiment, the following amplicon was obtained as a non-limiting illustrative example only of a suitable amplicon: R11723 junc11-18 (SEQ ID NO:496)
R11723junc11-18F (SEQ ID NO:494)—AGTGATGGAG-CAAAGTGCCG
R11723 junc11-18R (SEQ ID NO:495)—CAGCAGCTGAT-GCAAACTGAG
R11723 junc11-18 (SEQ ID NO:496)—AGTGATGGAG-CAAAGTGCCGGGATCATGTACCG-CAAGTCCTGTGCATCATCAGCGGC CTGTCT-CATCGCCTCTGCCGGGTACCAGTCCTTCTGCTCCC CAGGGAAACTGAACTCA GTTTGCATCAGCT-GCTG Expression of R11723 Transcripts, Which were Detected by Amplicon as Depicted in the Sequence Name R11723 junc11-18 (SEQ ID NO:496) in Normal and Cancerous Breast Tissues:

Expression of transcripts detectable by or according to junc11-18, R11723 junc11-18 (SEQ ID NO:496) amplicon and R11723 junc11-18F (SEQ ID NO:494) and R11723 junc11-18R (SEQ ID NO:495) primers was measured by real time PCR. In parallel the expression of four housekeeping genes PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), SDHA (GenBank Accession No. NM_004168 (SEQ ID NO:462); amplicon—SDHA-amplicon (SEQ ID NO:465)), and G6PD (GenBank Accession No. NM_000402 (SEQ ID NO:442); G6PD amplicon (SEQ ID NO:445)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 2__5, above), to obtain a value of fold up-regulation for each sample relative to median of the normal PM samples.

Figure 32:
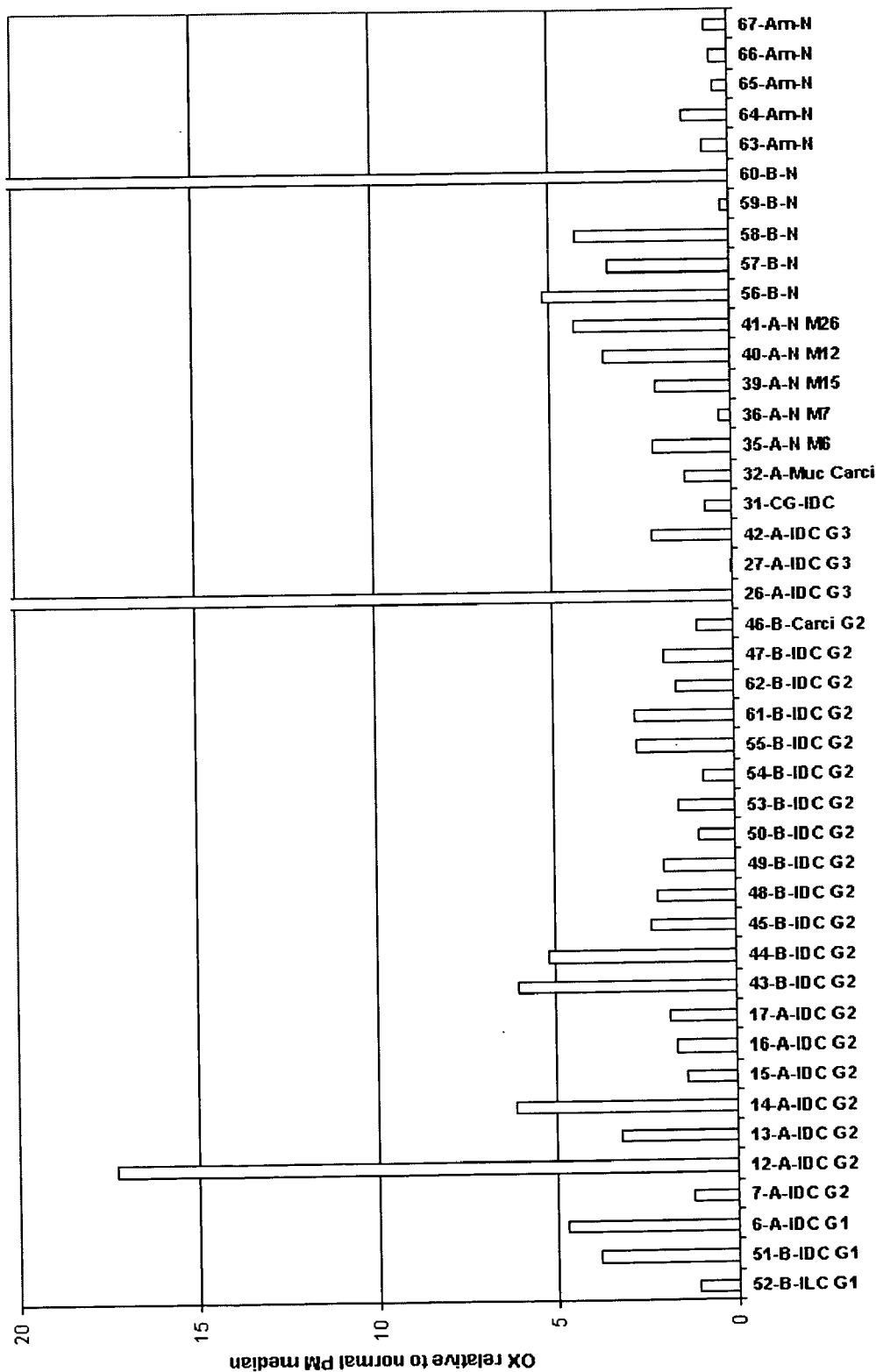
FIG. 32 is a histogram showing expression of R11723 transcripts, which are detectable by amplicon as depicted in sequence R11723 junc11-18 (SEQ ID NO:496) in normal and cancerous breast tissues.

FIG. 32 is a histogram showing over expression of the above-indicated transcripts in cancerous breast samples relative to the normal samples.

As is evident from FIG. 32, the expression of transcripts detectable by the above amplicon in a few cancer samples was higher than in the non-cancerous samples (Sample Nos. 56-60, 63-67, Table 2_5). Notably an over-expression of at least 5 fold was found in 5 out of 28 adenocarcinoma samples.

Primer pairs are also optionally and preferably encompassed within the present invention; for example, for the above experiment, the following primer pair was used as a non-limiting illustrative example only of a suitable primer pair: R11723 junc11-18F (SEQ ID NO:494) forward primer; and R11723 junc11-18R (SEQ ID NO:495) reverse primer.

The present invention also preferably encompasses any amplicon obtained through the use of any suitable primer pair; for example, for the above experiment, the following amplicon was obtained as a non-limiting illustrative example only of a suitable amplicon: R11723 junc11-18 (SEQ ID NO:496).

R11723junc11-18F (SEQ ID NO:494)—AGTGATGGAG-CAAAGTGCCG

R11723 junc11-18R (SEQ ID NO:495)—CAGCAGCTGAT-GCAAACTGAG

R11723 junc11-18 (SEQ ID NO:496)—AGTGATGGAG-CAAAGTGCCGGGATCATGTACCG-CAAGTCCTGTGCATCATCAGCGGC CTGTCT-CATCGCCTCTGCCGGGTACCAGTCCTTCTGCTCCC CAGGGAAACTGAACTCA GTTTGCATCAGCT-GCTG Expression of R11723 Transcripts, Which were Detected by Amplicon as Depicted in Sequence Name R11723 junc11-18 (SEQ ID NO:496) in Normal and Cancerous Colon Tissues:

Expression of transcripts detectable by or according to junc11-18, R11723 junc11-18 (SEQ ID NO:496) amplicon and R11723 junc11-18F (SEQ ID NO:494) and R11723 junc11-18R (SEQ ID NO:495) primers was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), G6PD (GenBank Accession No. NM_000402 (SEQ ID NO:442); G6PD amplicon (SEQ ID NO:445)), and RPS27A (GenBank Accession No. NM_002954 (SEQ ID NO:446); RPS27A amplicon (SEQ ID NO:446)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 41, 52, 62-67, 69-71, Table 2_3, above), to obtain a value of fold over expression for each sample relative to median of the normal PM samples.

Figure 33:
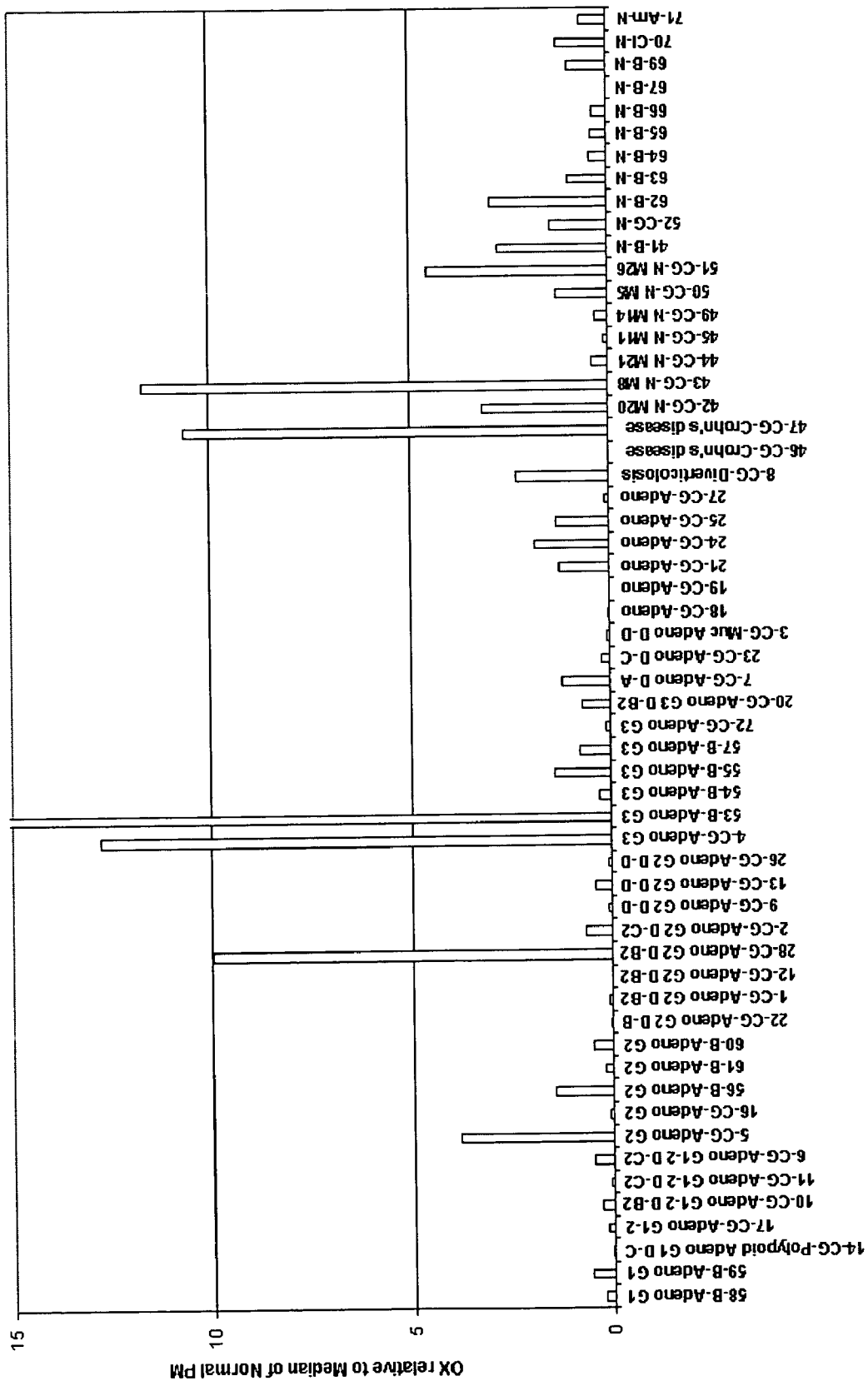
FIG. 33 is a histogram showing expression of R11723 transcripts, which are detectable by amplicon as depicted in sequence R11723 junc11-18 (SEQ ID NO:496) in normal and cancerous colon tissues.

FIG. 33 is a histogram showing over expression of the above-indicated transcripts in a few cancerous colon samples relative to the normal samples (Sample Nos. 41, 52, 62-67, 69-71 Table 2_3).

Primer pairs are also optionally and preferably encompassed within the present invention; for example, for the above experiment, the following primer pair was used as a non-limiting illustrative example only of a suitable primer pair: R11723 junc11-18F (SEQ ID NO:494) forward primer; and R11723 junc11-18R (SEQ ID NO:495) reverse primer.

The present invention also preferably encompasses any amplicon obtained through the use of any suitable primer pair; for example, for the above experiment, the following amplicon was obtained as a non-limiting illustrative example only of a suitable amplicon: R11723 junc11-18 (SEQ ID NO:496).

R11723junc11-18F (SEQ ID NO:494)—AGTGATGGAG-CAAAGTGCCG

R11723 junc11-18R (SEQ ID NO:495)—CAGCAGCTGAT-GCAAACTGAG

R11723 junc11-18 (SEQ ID NO:496)—AGTGATGGAG-CAAAGTGCCGGGATCATGTACCG-CAAGTCCTGTGCATCATCAGCGGC CTGTCT-CATCGCCTCTGCCGGGTACCAGTCCTTCTGCTCCC CAGGGAAACTGAACTCA GTTTGCATCAGCT-GCTG Expression of R11723 Transcripts, Which were Detected by Amplicon as Depicted in Sequence Name R11723 junc11-18 (SEQ ID NO:496) in Normal and Cancerous Lung Tissues:

Expression of transcripts detectable by or according to junc11-18, R11723 junc11-18 (SEQ ID NO:496) amplicon and R11723 junc11-18F (SEQ ID NO:494) and R11723 junc11-18R (SEQ ID NO:495) primers was measured by real time PCR. In parallel the expression of four housekeeping genes PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), SDHA (GenBank Accession No. NM_004168 (SEQ ID NO:462); amplicon—SDHA-amplicon (SEQ ID NO:465)), and UBC (GenBank Accession No. BC000449 (SEQ ID NO:458); amplicon—Ubiquitin-amplicon (SEQ ID NO:461)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2_4, above), to obtain a value of fold up-regulation for each sample relative to median of the normal PM samples.

Figure 34:
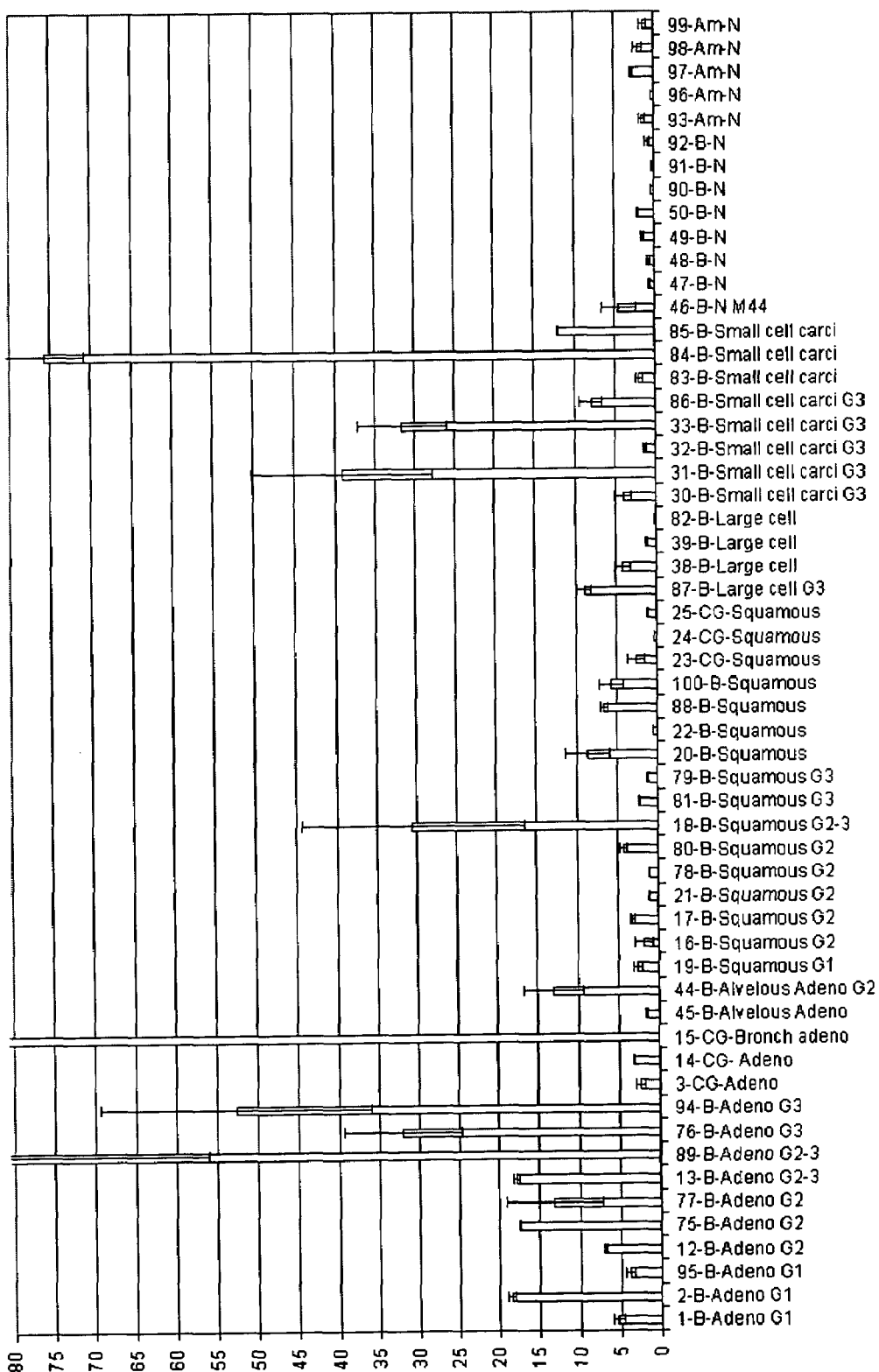
FIG. 34 is a histogram showing expression of R11723 transcripts, which are detectable by amplicon as depicted in sequence R11723 junc11-18 (SEQ ID NO:496) in normal and cancerous lung tissues.

FIG. 34 is a histogram showing over expression of the above-indicated transcripts in cancerous lung samples relative to the normal samples. Values represent the average of duplicate experiments. Error bars indicate the minimal and maximal values obtained.

As is evident from FIG. 34, the expression of transcripts detectable by the above amplicon in cancer samples was higher than in the non-cancerous samples (Sample Nos. 47-50, 90-93, 96-99 Table 2_4). Notably an over-expression of at least 5 fold was found in 11 out of 15 adenocarcinoma samples, 4 out of 16 squamous cell carcinoma samples, 1 out of 4 large cell carcinoma samples and in 5 out of 8 small cells carcinoma samples.

Primer pairs are also optionally and preferably encompassed within the present invention; for example, for the above experiment, the following primer pair was used as a non-limiting illustrative example only of a suitable primer pair: R11723 junc11-18F (SEQ ID NO:494) forward primer; and R11723 junc11-18R (SEQ ID NO:495) reverse primer.

The present invention also preferably encompasses any amplicon obtained through the use of any suitable primer pair; for example, for the above experiment, the following amplicon was obtained as a non-limiting illustrative example only of a suitable amplicon: R11723 junc11-18 (SEQ ID NO:496).

R11723junc11-18F (SEQ ID NO:494)—AGTGATG-GAGCAAAGTGCCGR11723 junc11-18R (SEQ ID NO:495)—CAGCAGCTGATGCAAACTGAG R11723 junc11-18 (SEQ ID NO:496)—amplicon: AGT-GATGGAGCAAAGTGCCGGGATCATGTAC-CGCAAGTCCTGTGCATCATCAGCGGC CTGTCT-CATCGCCTCTGCCGGGTACCAGTCCTTCTGCTCCC CAGGGAAACTGAACTCA GTTTGCATCAGCT-GCTG Expression of R11723 Transcripts Which are Detectable by Amplicon as Depicted in Sequence Name R11723 seg13 (SEQ ID NO:499) in Normal and Cancerous Prostate Tissues:

Expression of transcripts detectable by or according to seg13, R11723seg13 (SEQ ID NO:499) amplicon(s) and R11723seg13F (SEQ ID NO:497) and R11723seg13R (SEQ ID NO:498) primers was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), SDHA (GenBank Accession No. NM_004168 (SEQ ID NO:462); amplicon—SDHA-amplicon (SEQ ID NO:465)), RPL19 (GenBank Accession No. NM_000981 (SEQ ID NO:450); RPL19 amplicon (SEQ ID NO:453)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 42,48-53, 59-63 Table 2_1 above), to obtain a value of fold up-regulation for each sample relative to median of the normal PM samples.

Figure 35:
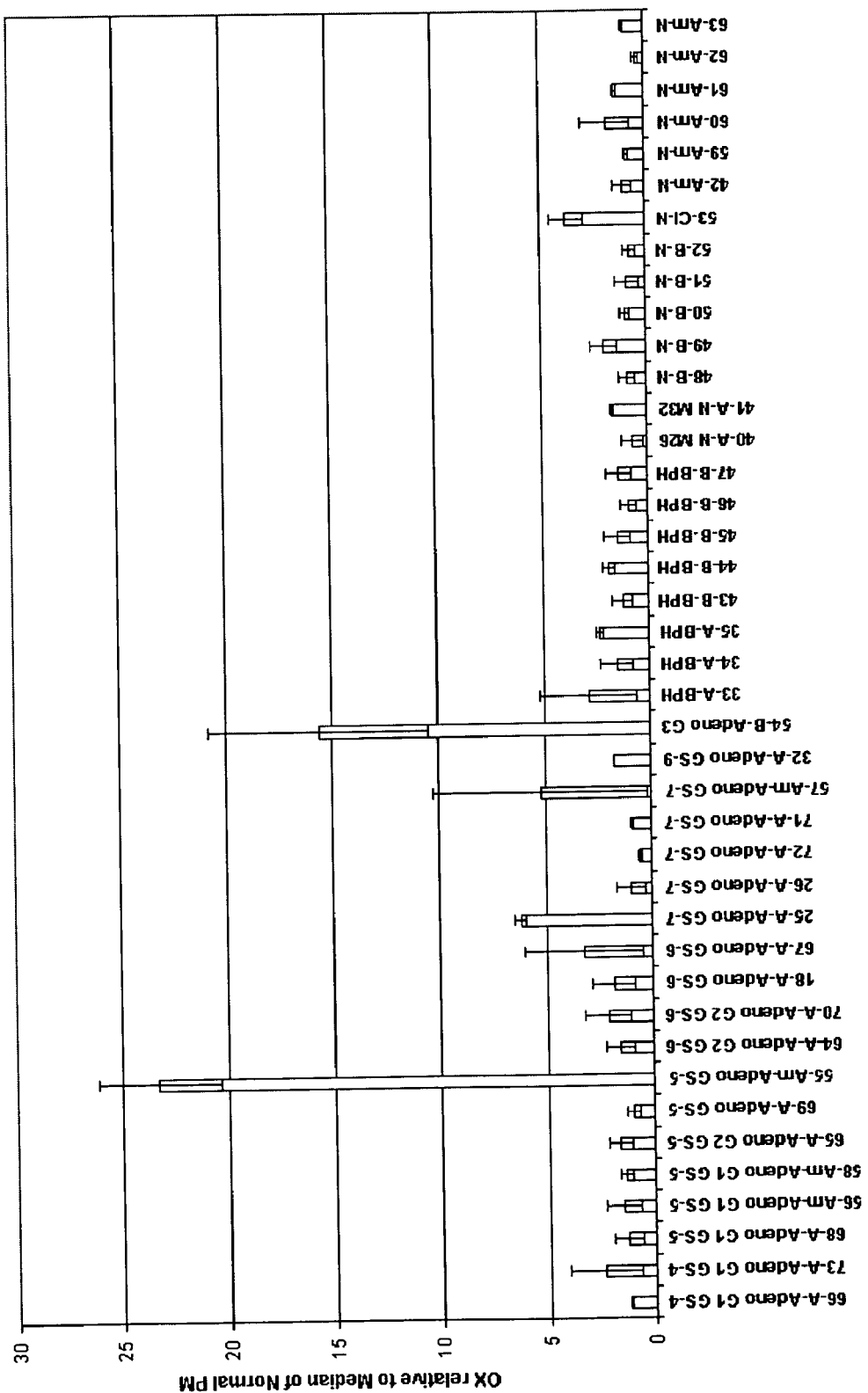
FIG. 35 is a histogram showing expression of R11723 transcripts, which are detectable by amplicon as depicted in sequence R11723seg13 (SEQ ID NO:499) in normal and cancerous prostate tissues.

FIG. 35 is a histogram showing expression of the above-indicated transcripts in cancerous prostate samples relative to the normal samples. Values represent the average of duplicate experiments. Error bars indicate the minimal and maximal values obtained.

As is evident from FIG. 35, the expression of transcripts detectable by the above amplicon in a few cancer samples was higher than in the non-cancerous samples (Sample Nos. 40-42,48-53,59-63, Table 2_1). Notably an over-expression of at least 5 fold was found in 4 out of 19 adenocarcinoma samples.

Primer pairs are also optionally and preferably encompassed within the present invention; for example, for the above experiment, the following primer pair was used as a non-limiting illustrative example only of a suitable primer pair: R11732seg13F (SEQ ID NO:497) forward primer; and R11732seg13R (SEQ ID NO:498) reverse primer.

The present invention also preferably encompasses any amplicon obtained through the use of any suitable primer pair; for example, for the above experiment, the following amplicon was obtained as a non-limiting illustrative example only of a suitable amplicon: R11732seg13 (SEQ ID NO:499).

R11732seg13F (SEQ ID NO:497)—ACACTAAAAGAA-CAAACACCTTGCTC

R11732seg13R (SEQ ID NO:498)—TCCTCAGAAGGCA-CATGAAAGA

R11732seg13 (SEQ ID NO:499)—ACACTAAAAGAA-CAAACACCTTGCTCTTCGAGATGAGA-CATTTTGCCAAGCAGTTGA CCACTTAGTTCTCAA-GAAGCAACTATCTCTTTCATGTGCCTTCTGAGGA The conversion of the R11723seg13 (SEQ ID NO:499) name to the currently available sequence version, as listed in Table 291, is as follows: R11723_1 seg14.

Description for Cluster T27396

Cluster T27396 features 12 transcript(s) and 44 segment(s) of interest, the names for which are given in Tables 338 and 339, respectively, the sequences themselves are given at the end of the application. The selected protein variants are given in table 340.

TABLE 338

Transcripts of interest
Transcript Name

T27396_PEA_1_T2 (SEQ ID NO: 282)
T27396_PEA_1_T3 (SEQ ID NO: 283)
T27396_PEA_1_T9 (SEQ ID NO: 284)
T27396_PEA_1_T11 (SEQ ID NO: 285)
T27396_PEA_1_T12 (SEQ ID NO: 286)
T27396_PEA_1_T13 (SEQ ID NO: 287)
T27396_PEA_1_T19 (SEQ ID NO: 288)
T27396_PEA_1_T20 (SEQ ID NO: 289)
T27396_PEA_1_T23 (SEQ ID NO: 290)
T27396_PEA_1_T27 (SEQ ID NO: 291)
T27396_PEA_1_T29 (SEQ ID NO: 292)
T27396_PEA_1_T30 (SEQ ID NO: 293)

TABLE 339

Segments of interest
Segment Name

T27396_PEA_1_node_0 (SEQ ID NO: 294)
T27396_PEA_1_node_19 (SEQ ID NO: 295)
T27396_PEA_1_node_31 (SEQ ID NO: 296)
T27396_PEA_1_node_43 (SEQ ID NO: 297)
T27396_PEA_1_node_45 (SEQ ID NO: 298)
T27396_PEA_1_node_49 (SEQ ID NO: 299)
T27396_PEA_1_node_55 (SEQ ID NO: 300)
T27396_PEA_1_node_57 (SEQ ID NO: 301)
T27396_PEA_1_node_67 (SEQ ID NO: 302)
T27396_PEA_1_node_2 (SEQ ID NO: 303)
T27396_PEA_1_node_3 (SEQ ID NO: 304)
T27396_PEA_1_node_4 (SEQ ID NO: 305)
T27396_PEA_1_node_6 (SEQ ID NO: 306)
T27396_PEA_1_node_7 (SEQ ID NO: 307)
T27396_PEA_1_node_9 (SEQ ID NO: 308)
T27396_PEA_1_node_10 (SEQ ID NO: 309)
T27396_PEA_1_node_12 (SEQ ID NO: 310)
T27396_PEA_1_node_13 (SEQ ID NO: 311)
T27396_PEA_1_node_16 (SEQ ID NO: 312)
T27396_PEA_1_node_18 (SEQ ID NO: 313)
T27396_PEA_1_node_21 (SEQ ID NO: 314)
T27396_PEA_1_node_22 (SEQ ID NO: 315)
T27396_PEA_1_node_23 (SEQ ID NO: 316)
T27396_PEA_1_node_25 (SEQ ID NO: 317)
T27396_PEA_1_node_29 (SEQ ID NO: 318)
T27396_PEA_1_node_34 (SEQ ID NO: 319)
T27396_PEA_1_node_36 (SEQ ID NO: 320)
T27396_PEA_1_node_38 (SEQ ID NO: 321)
T27396_PEA_1_node_40 (SEQ ID NO: 322)
T27396_PEA_1_node_48 (SEQ ID NO: 323)
T27396_PEA_1_node_53 (SEQ ID NO: 324)
T27396_PEA_1_node_54 (SEQ ID NO: 325)
T27396_PEA_1_node_58 (SEQ ID NO: 326)
T27396_PEA_1_node_59 (SEQ ID NO: 327)
T27396_PEA_1_node_60 (SEQ ID NO: 328)
T27396_PEA_1_node_61 (SEQ ID NO: 329)
T27396_PEA_1_node_62 (SEQ ID NO: 330)
T27396_PEA_1_node_63 (SEQ ID NO: 331)
T27396_PEA_1_node_64 (SEQ ID NO: 332)
T27396_PEA_1_node_65 (SEQ ID NO: 333)
T27396_PEA_1_node_66 (SEQ ID NO: 334)
T27396_PEA_1_node_68 (SEQ ID NO: 335)
T27396_PEA_1_node_69 (SEQ ID NO: 336)
T27396_PEA_1_node_70 (SEQ ID NO: 337)

TABLE 340

Proteins of interest

| Protein Name | Corresponding Transcript(s) |
|---|---|
| T27396_PEA_1_P3 (SEQ ID NO: 339) | T27396_PEA_1_T2 (SEQ ID NO: 282) |
| T27396_PEA_1_P4 (SEQ ID NO: 340) | T27396_PEA_1_T3 (SEQ ID NO: 283) |
| T27396_PEA_1_P10 (SEQ ID NO: 341) | T27396_PEA_1_T9 (SEQ ID NO: 284) |
| T27396_PEA_1_P12 (SEQ ID NO: 342) | T27396_PEA_1_T11 (SEQ ID NO: 285); T27396_PEA_1_T19 (SEQ ID NO: 288) |
| T27396_PEA_1_P13 (SEQ ID NO: 343) | T27396_PEA_1_T12 (SEQ ID NO: 286) |
| T27396_PEA_1_P14 (SEQ ID NO: 344) | T27396_PEA_1_T13 (SEQ ID NO: 287) |
| T27396_PEA_1_P18 (SEQ ID NO: 345) | T27396_PEA_1_T20 (SEQ ID NO: 289) |
| T27396_PEA_1_P24 (SEQ ID NO: 346) | T27396_PEA_1_T27 (SEQ ID NO: 291) |
| T27396_PEA_1_P26 (SEQ ID NO: 347) | T27396_PEA_1_T29 (SEQ ID NO: 292) |
| T27396_PEA_1_P27 (SEQ ID NO: 348) | T27396_PEA_1_T30 (SEQ ID NO: 293) |
| T27396_PEA_1_P30 (SEQ ID NO: 349) | T27396_PEA_1_T23 (SEQ ID NO: 290) |

These sequences are variants of the known protein Suppressor of tumorigenicity 14 (SEQ ID NO:338) (SwissProt accession identifier ST14_HUMAN (SEQ ID NO:594); known also according to the synonyms EC 3.4.21.-; Matriptase; Membrane-type serine protease 1; MT-SP1; Prostamin; Serine protease TADG-15; Tumor associated differentially-expressed gene-15 protein), referred to herein as the previously known protein.

Protein Suppressor of tumorigenicity 14 (SEQ ID NO:338) is known or believed to have the following function(s): Degrades extracellular matrix. Proposed to play a role in breast cancer invasion and metastasis. Exhibits trypsin-like activity as defined by cleavage of synthetic substrates with Arg or Lys as the P1 site. The sequence for protein Suppressor of tumorigenicity 14 (SEQ ID NO:338) is given at the end of the application, as "Suppressor of tumorigenicity 14 (SEQ ID NO:338) amino acid sequence". Known polymorphisms for this sequence are as shown in Table 341.

TABLE 341

Amino acid mutations for Known Protein

| SNP position(s) on amino acid sequence | Comment |
|---|---|
| 327-329 | FEA -> GTR |
| 381 | R -> S |
| 674 | A -> V |

Protein Suppressor of tumorigenicity 14 (SEQ ID NO:338) localization is believed to be Type II membrane protein (Probable).

This protein was identified as being overexpressed in ovarian cancer according to a cancer detecting method of the present invention, as described herein, and also according to public chip data.

The following GO Annotation(s) apply to the previously known protein. The following annotation(s) were found: proteolysis and peptidolysis, which are annotation(s) related to Biological Process; chymotrypsin; trypsin; serine-type peptidase; hydrolase, which are annotation(s) related to Molecular Function; and integral plasma membrane protein, which are annotation(s) related to Cellular Component.

The GO assignment relies on information from one or more of the SwissProt/TremB1 Protein knowledgebase, available from.ncbi.nlm.nih.gov/projects/LocusLink/>.

Cluster T27396 is overexpressed in ovary, as detected by publicly available chip results.

Cluster T27396 can be used as a diagnostic marker according to overexpression of transcripts of this cluster in cancer. Expression of such transcripts in normal tissues is also given according to the previously described methods. The term "number" in the left hand column of the table and the numbers on the y-axis of the figure below refer to weighted expression of ESTs in each category, as "parts per million" (ratio of the expression of ESTs for a particular cluster to the expression of all ESTs in that category, according to parts per million).

Figure 36:
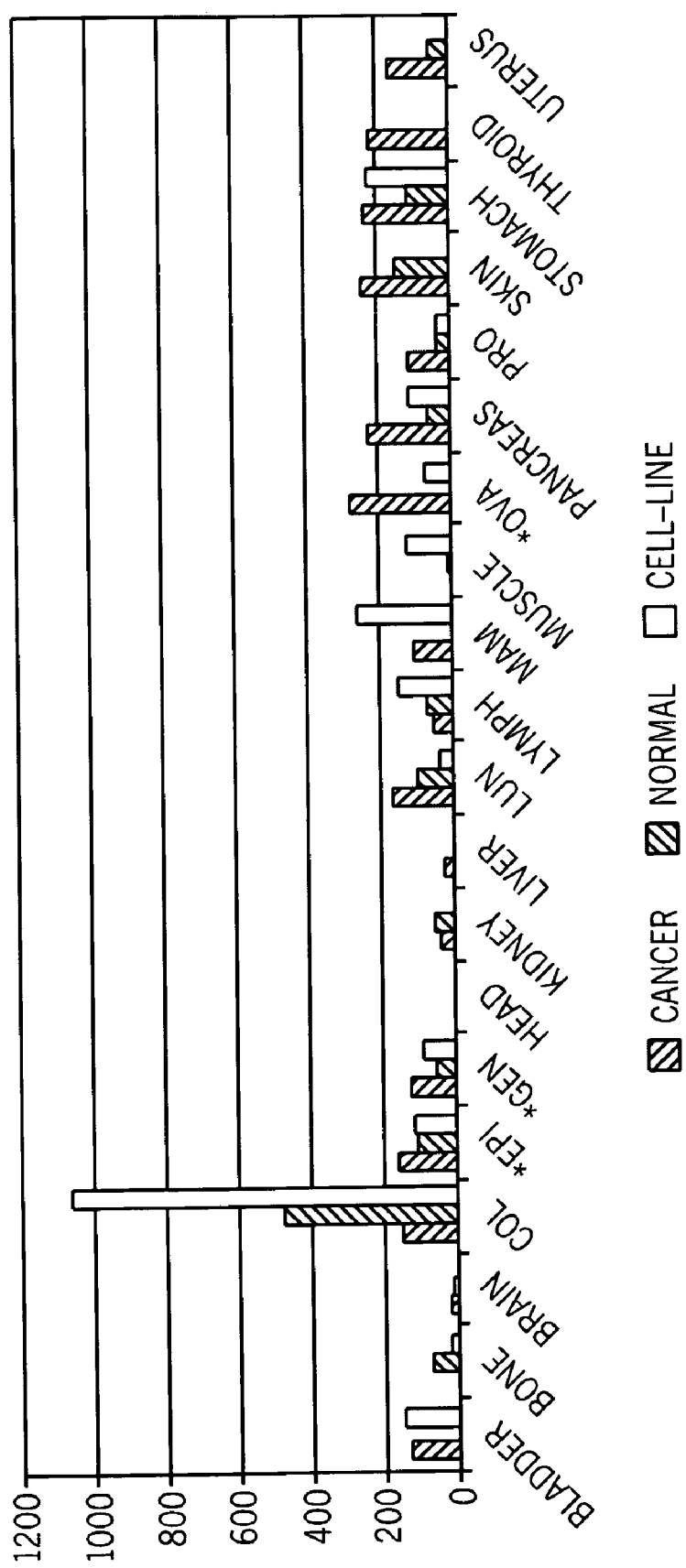
FIG. 36 is a histogram showing Cancer and cell-line vs. normal tissue expression for Cluster T27396, demonstrating overexpression in epithelial malignant tumors, a mixture of malignant tumors from different tissues and ovarian carcinoma.

Overall, the following results were obtained as shown with regard to the histograms in FIG. 36 and Table 342. This cluster is overexpressed (at least at a minimum level) in the following pathological conditions: epithelial malignant tumors, a mixture of malignant tumors from different tissues and ovarian carcinoma.

TABLE 342

Normal tissue distribution

| Name of Tissue | Number |
|---|---|
| bladder | 0 |
| bone | 64 |
| brain | 5 |
| colon | 472 |
| epithelial | 99 |
| general | 47 |
| head and neck | 0 |
| kidney | 53 |
| liver | 0 |
| lung | 96 |
| lymph nodes | 65 |
| breast | 4 |
| muscle | 5 |
| ovary | 0 |
| pancreas | 61 |
| prostate | 30 |
| skin | 147 |
| stomach | 109 |
| Thyroid | 0 |
| uterus | 54 |

TABLE 343

P values and ratios for expression in cancerous tissue

| Name of Tissue | P1 | P2 | SP1 | R3 | SP2 | R4 |
|---|---|---|---|---|---|---|
| bladder | 1.2e-01 | 9.2e-02 | 1.0e-01 | 4.1 | 6.8e-02 | 3.8 |
| bone | 9.2e-01 | 8.7e-01 | 1 | 0.3 | 9.7e-01 | 0.5 |
| brain | 3.5e-01 | 4.7e-01 | 5.2e-01 | 1.8 | 7.0e-01 | 1.2 |
| colon | 2.6e-01 | 2.9e-01 | 1 | 0.3 | 5.8e-01 | 0.4 |

TABLE 343-continued

P values and ratios for expression in cancerous tissue

| Name of Tissue | P1 | P2 | SP1 | R3 | SP2 | R4 |
|---|---|---|---|---|---|---|
| epithelial | 1.5e−04 | 1.0e−02 | 2.7e−03 | 1.4 | 2.4e−02 | 1.1 |
| general | 4.8e−08 | 1.1e−05 | 1.5e−12 | 2.4 | 8.3e−12 | 1.9 |
| head and neck | 2.1e−01 | 3.3e−01 | 1 | 1.0 | 1 | 1.0 |
| kidney | 7.1e−01 | 8.2e−01 | 8.0e−01 | 0.8 | 9.2e−01 | 0.6 |
| liver | 1.8e−01 | 4.5e−01 | 1 | 1.3 | 1 | 1.1 |
| lung | 2.8e−01 | 6.8e−01 | 1.5e−01 | 1.5 | 6.2e−01 | 0.9 |
| lymph nodes | 6.5e−01 | 6.6e−01 | 7.4e−01 | 0.8 | 2.4e−01 | 1.3 |
| breast | 1.2e−01 | 3.4e−01 | 1.5e−01 | 2.6 | 2.4e−02 | 3.3 |
| muscle | 9.2e−01 | 4.8e−01 | 1 | 0.8 | 5.9e−02 | 3.2 |
| ovary | 4.5e−02 | 3.6e−02 | 2.2e−03 | 5.3 | 8.3e−03 | 4.4 |
| pancreas | 4.1e−02 | 5.0e−02 | 3.8e−03 | 1.7 | 9.8e−03 | 1.7 |
| prostate | 3.1e−01 | 3.3e−01 | 5.8e−02 | 2.5 | 1.0e−01 | 2.0 |
| skin | 6.3e−01 | 7.9e−01 | 3.2e−01 | 1.1 | 1 | 0.2 |
| stomach | 3.5e−01 | 5.1e−01 | 2.6e−01 | 1.6 | 1.8e−01 | 1.5 |
| Thyroid | 1.6e−01 | 1.6e−01 | 3.0e−01 | 2.6 | 3.0e−01 | 2.6 |
| uterus | 2.4e−01 | 6.1e−01 | 5.5e−02 | 1.6 | 3.5e−01 | 1.0 |

As noted above, cluster T27396 features 12 transcript(s), which were listed in Table 338 above. These transcript(s) encode for protein(s) which are variant(s) of protein Suppressor of tumorigenicity 14 (SEQ ID NO:338). A description of each variant protein according to the present invention is now provided.

Variant protein T27396_PEA_1_P3 (SEQ ID NO:339) according to the present invention has an amino acid sequence as given at the end of the application; it is encoded by transcript(s) T27396_PEA_1_T2 (SEQ ID NO:282). An alignment is given to the known protein (Suppressor of tumorigenicity 14 (SEQ ID NO:338)) at the end of the application. One or more alignments to one or more previously published protein sequences are given at the end of the application. A brief description of the relationship of the variant protein according to the present invention to each such aligned protein is as follows:

Comparison report between T27396$_{13}$ PEA$_{13}$ 1$_{13}$ P3 (SEQ ID NO:339) and ST14$_{13}$ HUMAN (SEQ ID NO:594):

1. An isolated chimeric polypeptide encoding for T27396$_{13}$ PEA$_{13}$ 1$_{13}$ P3 (SEQ ID NO:339), comprising a first amino acid sequence being at least 90% homologous to MGSDRARKGGGGPKDFGAGLKYNSRHEKVNGLEEGVEFLPVNNVKKVEKHGPGRWVV LAAVLIGLLLVLLGIGFLVWHLQYRDVRVQKVFNGYMRITNENFVDAYENSNSTEFVSLA SK corresponding to amino acids 1-119 of ST14$_{13}$ HUMAN (SEQ ID NO:594), which also corresponds to amino acids 1-119 of T27396$_{13}$ PEA$_{13}$ 1$_{13}$ P3 (SEQ ID NO:339), and a second amino acid sequence being at least 90% homologous to LKLLYSGVPFLGPYHKESAVTAFSEGSVIAYYWSEFSIPQHLVEEAERVMAEERVVMLPP RARSLKSFVVTSVVAFPTDSKTVQRTQDNSCSFGLHARGVELMRFTTP GFPDSPYPAHAR CQWALRGDADSVLSLTFRSFDLASCDERGSDLVTVYNTLSPMEPHALVQLCGTYPPSYNL TFHSSQNVLLITLITNTERRHPGFEATFFQLPRMSSCGGRLRKAQGTFNSPYYPGHYPPNID CTWNIEVPNNQHVKVRFKFFYLLEPGVPAGTCPKDYVEINGEKYCGERSQFVVTSNSNKI TVRFHSDQSYTDTGFLAEYLSYDSSDPCPGQFTCRTGRCIRKELRCDGWADCTDHSD ELN CSCDAGHQFTCKNKFCKPLFWVCDSVNDCGDNSDEQGCSCPAQTFRCSNGKCLSKSQQC NGKDDCGDGSDEASCPKVNVVTCTKHTYRCLNGLCLSKGNPECDGKEDCSDGSDEKDC DCGLRSFTRQARVVGGTDADEGEWPWQVSLHALGQGHICGASLISPNWLVSAAHCYIDD RGFRYSDPTQWTAFLGLHDQSQRSAPGVQERRLKRIISHPFFNDFTFDYDIALLELEKPAE YSSMVRPICLPDASHVFPAGKAIWVTGWGHTQYGGTGALILQKGEIRVINQTTCENLLPQ QITPRMMCVGFLSGGVDSCQGDSGGPLSSVEADGRIFQAGVVSWGDGCAQRNKPGVYTR LPLFRDWIKENTGV corresponding to amino acids 124-855 of ST14$_{13}$ HUMAN (SEQ ID NO:594), which also corresponds to amino acids 120-851 of T27396$_{13}$ PEA$_{13}$ 1$_{13}$ P3 (SEQ ID NO:339), wherein said first amino acid sequence and second amino acid sequence are contiguous and in a sequential order.

2. An isolated chimeric polypeptide encoding for an edge portion of T27396$_{13}$ PEA$_{13}$ 1$_{13}$ P3 (SEQ ID NO:339), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KL, having a structure as follows: a sequence starting from any of amino acid numbers 119-x to 119; and ending at any of amino acid numbers 120+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T27396$_{13}$ PEA$_{13}$ 1$_{13}$ P3 (SEQ ID NO:339) also has the following non-silent SNPs (Single Nucleotide Polymorphisms) as listed in Table 344, (given according to their position(s) on the amino acid sequence, with the alternative amino acid(s) listed; the last column indicates whether the SNP is known or not; the presence of known SNPs in variant protein T27396$_{13}$ PEA$_{13}$ 1$_{13}$ P3 (SEQ ID NO:339) sequence provides support for the deduced sequence of this variant protein according to the present invention).

TABLE 344

Amino acid mutations

| SNP position(s) on amino acid sequence | Alternative amino acid(s) | Previously known SNP? |
|---|---|---|
| 70 | L -> | No |
| 85 | R -> H | No |
| 243 | A -> | No |
| 245 | R -> | No |
| 269 | S -> | No |
| 285 | A -> | No |
| 344 | Q -> | No |
| 344 | Q -> H | No |
| 377 | R -> S | No |
| 570 | C -> R | No |
| 596 | K -> R | No |
| 643 | S -> | No |
| 670 | A -> V | No |
| 681 | S -> R | No |
| 681 | S -> | No |
| 725 | P -> | No |
| 771 | T -> P | No |
| 787 | V -> | No |
| 830 | N -> Y | No |

The glycosylation sites of variant protein T27396_PEA_1_P3 (SEQ ID NO:339), as compared to the known protein Suppressor of tumorigenicity 14 (SEQ ID NO:338), are described in Table 345 (given according to their position(s) on the amino acid sequence in the first column; the second column indicates whether the glycosylation site is present in the variant protein; and the last column indicates whether the position is different on the variant protein).

TABLE 345

Glycosylation site(s)

| Position(s) on known amino acid sequence | Present in variant protein? | Position in variant protein? |
| --- | --- | --- |
| 485 | yes | 481 |
| 772 | yes | 768 |
| 302 | yes | 298 |
| 109 | yes | 109 |

Variant protein T27396_PEA_1_P3 (SEQ ID NO:339) is encoded by the following transcript(s): T27396_PEA_1_T2 (SEQ ID NO:282), for which the sequence(s) is/are given at the end of the application. The coding portion of transcript T27396_PEA_1_T2 (SEQ ID NO:282) is shown in bold; this coding portion starts at position 211 and ends at position 2763. The transcript also has the following SNPs as listed in Table 346 (given according to their position on the nucleotide sequence, with the alternative nucleic acid listed; the last column indicates whether the SNP is known or not; the presence of known SNPs in variant protein T27396_PEA_1_P3 (SEQ ID NO:339) sequence provides support for the deduced sequence of this variant protein according to the present invention).

TABLE 346

Nucleic acid SNPs

| SNP position on nucleotide sequence | Alternative nucleic acid | Previously known SNP? |
| --- | --- | --- |
| 206 | G -> T | No |
| 207 | G -> T | No |
| 420 | G -> | No |
| 464 | G -> A | No |
| 729 | C -> A | No |
| 938 | C -> | No |
| 944 | G -> | No |
| 1017 | C -> | No |
| 1065 | C -> | No |
| 1065 | C -> A | No |
| 1242 | G -> | No |
| 1242 | G -> T | No |
| 1339 | C -> A | No |
| 1413 | T -> C | No |
| 1918 | T -> C | No |
| 1941 | C -> T | No |
| 1997 | A -> G | No |
| 2137 | T -> | No |
| 2219 | C -> T | No |
| 2253 | C -> | No |
| 2253 | C -> G | No |
| 2383 | C -> | No |
| 2521 | A -> C | No |
| 2571 | G -> | No |
| 2698 | A -> T | No |
| 2796 | G -> A | No |
| 2797 | C -> A | No |
| 2816 | C -> | No |
| 2816 | C -> A | No |
| 3006 | A -> | No |
| 3006 | A -> C | No |
| 3041 | A -> C | No |

TABLE 346-continued

Nucleic acid SNPs

| SNP position on nucleotide sequence | Alternative nucleic acid | Previously known SNP? |
| --- | --- | --- |
| 3051 | G -> A | No |
| 3065 | T -> C | No |
| 3085 | G -> C | No |
| 3088 | A -> G | No |
| 3113 | A -> G | No |
| 3147 | C -> T | No |
| 3156 | G -> | No |
| 3165 | G -> | No |
| 3291 | T -> A | No |

Variant protein T27396_PEA_1_P4 (SEQ ID NO:340) according to the present invention has an amino acid sequence as given at the end of the application; it is encoded by transcript(s) T27396_PEA_1_T3 (SEQ ID NO:283). An alignment is given to the known protein (Suppressor of tumorigenicity 14 (SEQ ID NO:338)) at the end of the application. One or more alignments to one or more previously published protein sequences are given at the end of the application. A brief description of the relationship of the variant protein according to the present invention to each such aligned protein is as follows:

Comparison report between T27396_PEA_1_P4 (SEQ ID NO:340) and ST14_HUMAN (SEQ ID NO:594):

1. An isolated chimeric polypeptide encoding for T27396_PEA_1_P4 (SEQ ID NO:340), comprising a first amino acid sequence being at least 90% homologous to MGSDRARKGGGGPKDFGAGLKYNSRHEK-VNGLEEGVEFLPVNNVKKVEKHGPGRWVV LAAV-LIGLLLVLLGIGFLVWHLQYRD-VRVQKVFNGYMRITNENFVDAYENSNSTEFVSLA SKVKDALKLLYSGVPFLGPYHKESAV-TAFSEGSVIAYYWSEFSIPQHLVEEAERVMAEER VVMLPPRARSLKSFVVTSVVAFPTDSKTVQRTQD corresponding to amino acids 1-211 of ST14_HUMAN (SEQ ID NO:594), which also corresponds to amino acids 1-211 of T27396_PEA_1_P4 (SEQ ID NO:340), a second amino acid sequence being at least 70%, optionally at least 80%, preferably at least 85%, more preferably at least 90% and most preferably at least 95% homologous to a polypeptide having the sequence TLPSPAPTRALLLVSCAD (SEQ ID NO:596) corresponding to amino acids 212-229 of T27396_PEA_1_P4 (SEQ ID NO:340), and a third amino acid sequence being at least 90% homologous to SCSFGLHARGVELMR-FTTPGFPDSPYPAHARCQWALRGDADSV-LSLTFRSFDLASCDERG SDLVTVYNTLSPME-PHALVQLCGTYPPSYNLTFHSSQNVLLITLITNTERRH PGFEATFFQL PRMSSCGGRLRKAQGTFNSPYYPG-HYPPNIDCTWNIEVPNNQHVKVRFKFFYLLEPGVPA GTCPKDYVEINGEKYCGERSQFVVTSN-SNKITVRFHSDQSYTDTGFLAEYLSYDSSDPCPG QFT-CRTGRCIRKELRCDGWADCTDHSDELNC-SCDAGHQFTCKNKFCKPLFWVCDSVNDC GDNSDEQGCSCPAQTFRCSNGK-CLSKSQQCNGKDDCGDGSDEASCPKVNV-VTCTKHTYR CLNGLCLSKGNPECDGKEDCSDGSDE-KDCDCGLRSFTRQARVVGGTDADEGEWPWQVS LHALGQGHICGASLISPNWLVSAAHCY-IDDRGFRYSDPTQWTAFLGLHDQSQRSAPGVQE RRLKRIISHPFFNDFTFDYDIALLELE-KPAEYSSMVRPICLPDASHVFPAGKAIWVTGWGHT QYGGTGALILQKGEIRVINQTTCENLL- PQQITPRMMCVGFLSGGVDSCQGDSGGPLSSVEA DGRIFQAGVVSWGDGCAQRNKPGVYTRL- PLFRDWIKENTGV corresponding to amino acids 213-855 of ST14_HUMAN (SEQ ID NO:594), which also corresponds to amino acids 230-872 of T27396_PEA__1_P4 (SEQ ID NO:340), wherein said first amino acid sequence, second amino acid sequence and third amino acid sequence are contiguous and in a sequential order.

2. An isolated polypeptide encoding for an edge portion of T27396_PEA__1_P4 (SEQ ID NO:340), comprising an amino acid sequence being at least 70%, optionally at least about 80%, preferably at least about 85%, more preferably at least about 90% and most preferably at least about 95% homologous to the sequence encoding for TLPSPAP- TRALLLVSCAD (SEQ ID NO:596), corresponding to T27396_PEA__1_P4 (SEQ ID NO:340).

3. A bridge portion of T27396_PEA__1_P4 (SEQ ID NO:340), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DT, having a structure as follows (numbering according to T27396_PEA__1_P4): a sequence starting from any of amino acid numbers 211-x to 211; and ending at any of amino acid numbers 212+((n−2)−x), in which x varies from 0 to n−2.

A bridge portion of T27396_PEA__1_P4 (SEQ ID NO:340), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DS, having a structure as follows (numbering according to T27396_PEA__1_P4): a sequence starting from any of amino acid numbers 229-x to 229; and ending at any of amino acid numbers 230+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T27396_PEA__1_P4 (SEQ ID NO:340) also has the following non-silent SNPs (Single Nucleotide Polymorphisms) as listed in Table 347, (given according to their position(s) on the amino acid sequence, with the alternative amino acid(s) listed; the last column indicates whether the SNP is known or not; the presence of known SNPs in variant protein T27396_PEA__1_P4 (SEQ ID NO:340) sequence provides support for the deduced sequence of this variant protein according to the present invention).

TABLE 347

Amino acid mutations

| SNP position(s) on amino acid sequence | Alternative amino acid(s) | Previously known SNP? |
| --- | --- | --- |
| 70 | L -> | No |
| 85 | R -> H | No |
| 264 | A -> | No |
| 266 | R -> | No |

TABLE 347-continued

Amino acid mutations

| SNP position(s) on amino acid sequence | Alternative amino acid(s) | Previously known SNP? |
| --- | --- | --- |
| 290 | S -> | No |
| 306 | A -> | No |
| 365 | Q -> | No |
| 365 | Q -> H | No |
| 398 | R -> S | No |
| 591 | C -> R | No |
| 617 | K -> R | No |
| 664 | S -> | No |
| 691 | A -> V | No |
| 702 | S -> | No |
| 702 | S -> R | No |
| 746 | P -> | No |
| 792 | T -> P | No |
| 808 | V -> | No |
| 851 | N -> Y | No |

The glycosylation sites of variant protein T27396_PEA__1_P4 (SEQ ID NO:340), as compared to the known protein Suppressor of tumorigenicity 14 (SEQ ID NO:338), are described in Table 348 (given according to their position(s) on the amino acid sequence in the first column; the second column indicates whether the glycosylation site is present in the variant protein; and the last column indicates whether the position is different on the variant protein).

TABLE 348

Glycosylation site(s)

| Position(s) on known amino acid sequence | Present in variant protein? | Position in variant protein? |
| --- | --- | --- |
| 485 | yes | 502 |
| 772 | yes | 789 |
| 302 | yes | 319 |
| 109 | yes | 109 |

Variant protein T27396_PEA__1_P4 (SEQ ID NO:340) is encoded by the following transcript(s): T27396_PEA__1_T3 (SEQ ID NO:283), for which the sequence(s) is/are given at the end of the application. The coding portion of transcript T27396_PEA__1_T3 (SEQ ID NO:283) is shown in bold; this coding portion starts at position 211 and ends at position 2826. The transcript also has the following SNPs as listed in Table 349 (given according to their position on the nucleotide sequence, with the alternative nucleic acid listed; the last column indicates whether the SNP is known or not; the presence of known SNPs in variant protein T27396_PEA__1_P4 (SEQ ID NO:340) sequence provides support for the deduced sequence of this variant protein according to the present invention).

TABLE 349

Nucleic acid SNPs

| SNP position on nucleotide sequence | Alternative nucleic acid | Previously known SNP? |
| --- | --- | --- |
| 206 | G -> T | No |
| 207 | G -> T | No |
| 420 | G -> | No |
| 464 | G -> A | No |
| 741 | C -> A | No |
| 1001 | C -> | No |
| 1007 | G -> | No |

TABLE 349-continued

Nucleic acid SNPs

| SNP position on nucleotide sequence | Alternative nucleic acid | Previously known SNP? |
|---|---|---|
| 1080 | C -> | No |
| 1128 | C -> | No |
| 1128 | C -> A | No |
| 1305 | G -> | No |
| 1305 | G -> T | No |
| 1402 | C -> A | No |
| 1476 | T -> C | No |
| 1981 | T -> C | No |
| 2004 | C -> T | No |
| 2060 | A -> G | No |
| 2200 | T -> | No |
| 2282 | C -> T | No |
| 2316 | C -> | No |
| 2316 | C -> G | No |
| 2446 | C -> | No |
| 2584 | A -> C | No |
| 2634 | G -> | No |
| 2761 | A -> T | No |
| 2859 | G -> A | No |
| 2860 | C -> A | No |
| 2879 | C -> | No |
| 2879 | C -> A | No |
| 3069 | A -> | No |
| 3069 | A -> C | No |
| 3104 | A -> C | No |
| 3114 | G -> A | No |
| 3128 | T -> C | No |
| 3148 | G -> C | No |
| 3151 | A -> G | No |
| 3176 | A -> G | No |
| 3210 | C -> T | No |
| 3219 | G -> | No |
| 3228 | G -> | No |
| 3354 | T -> A | No |

Variant protein T27396_PEA_1_P10 (SEQ ID NO:341) according to the present invention has an amino acid sequence as given at the end of the application; it is encoded by transcript(s) T27396_PEA_1_T9 (SEQ ID NO:284). An alignment is given to the known protein (Suppressor of tumorigenicity 14 (SEQ ID NO:338)) at the end of the application. One or more alignments to one or more previously published protein sequences are given at the end of the application. A brief description of the relationship of the variant protein according to the present invention to each such aligned protein is as follows:

Comparison report between T27396_PEA_1_P10 (SEQ ID NO:341) and ST14_HUMAN SEQ ID NO:594):

1. An isolated chimeric polypeptide encoding for T27396_PEA_1_P10 (SEQ ID NO:341), comprising a first amino acid sequence being at least 90% homologous to MGSDRARKGGGGPKDFGAGLKYNSRHEK-VNGLEEGVEFLPVNNVKKVEKHGPGRWVV LAAV-LIGLLLVLLGIGFLVWHLQYRD-VRVQKVFNGYMRITNENFVDAYENSNSTEFVSLA SKVKDALKLLYSGVPFLGPYHKESAV-TAFSEGSVIAYYWSEFSIPQHLVEEAERVMAEER VVMLPPRARSLKSFVVTSVVAFPTDSK-TVQRTQDNSCSFGLHARGVELMRFTTPGFPDSP YPA-HARCQWALRGDADSVLSLTFRSFDLAS-CDERGSDLVTVYNTLSPMEPHALVQLCGT YPPSYNLTFHSSQNVLLITLITNTER-RHPGFEATFFQLPRMSSCGGRLRKAQGTFNSPYYPG HYPPNIDCTWNIEVPNNQHVKVRFK-FFYLLEPGVPAGTCPKDYVEINGEKYCGERSQFVV TSNSNKITVRFHSDQSYTDTGFLAEYL-SYDSSDPCPGQFTCRTGRCIRKELRCDGWADCTD HSDELNCSCDAGHQFTCKNKFCKPLF-WVCDSVNDCGDNSDEQGC corresponding to amino acids 1-523 of ST14_HUMAN (SEQ ID NO:594), which also corresponds to amino acids 1-523 of T27396_PEA_1_P10 (SEQ ID NO:341), a second amino acid sequence bridging amino acid sequence comprising of M, and a third amino acid sequence being at least 90% homologous to NVVTCT-KHTYRCLNGLCLSKGNPECDGKEDCS-DGSDEKDCDCGLRSFTRQARVVGGTD ADEGEWP-WQVSLHALGQGHICGASLISPNWLVSAAHCYIDDRG FRYSDPTQWTAFLGLH DQSQRSAPGVQERRLKRI-ISHPFFNDFTFDYDIALLELEKPAEY-SSMVRPICLPDASHVFPA GKAIWVTGWGHTQYGGT-GALILQKGEIRVINQTTCENLLPQQITPRMMCVGFLSG GVDSC QGDSGGPLSSVEADGRIFQAGVVSWGDG-CAQRNKPGVYTRLPLFRDWIKENTGV corresponding to amino acids 563-855 of ST14_HUMAN (SEQ ID NO:594), which also corresponds to amino acids 525-817 of T27396_PEA_1_P10 (SEQ ID NO:341), wherein said first amino acid sequence, second amino acid sequence and third amino acid sequence are contiguous and in a sequential order.

2. An isolated polypeptide encoding for an edge portion of T27396_PEA_1_P10 (SEQ ID NO:341), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CM having a structure as follows (numbering according to T27396_PEA_1_P10): a sequence starting from any of amino acid numbers 523-x to 523; and ending at any of amino acid numbers 525+((n−2)−x), in which x varies from 0 to n−2.

An isolated polypeptide encoding for an edge portion of T27396_PEA_1_P10 (SEQ ID NO:341), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise MN having a structure as follows (numbering according to T27396_PEA_1_P10): a sequence starting from any of amino acid numbers 524-x to 524; and ending at any of amino acid numbers 525+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T27396_PEA_1_P10 (SEQ ID NO:341) also has the following non-silent SNPs (Single Nucleotide Polymorphisms) as listed in Table 350, (given according to their position(s) on the amino acid sequence, with the alternative amino acid(s) listed; the last column indicates whether the SNP is known or not; the presence of known SNPs in variant protein T27396_PEA_1_P10 (SEQ ID NO:341) sequence provides support for the deduced sequence of this variant protein according to the present invention).

TABLE 350

Amino acid mutations

| SNP position(s) on amino acid sequence | Alternative amino acid(s) | Previously known SNP? |
|---|---|---|
| 70 | L -> | No |
| 85 | R -> H | No |
| 247 | A -> | No |
| 249 | R -> | No |
| 273 | S -> | No |
| 289 | A -> | No |
| 348 | Q -> | No |
| 348 | Q -> H | No |
| 381 | R -> S | No |
| 536 | C -> R | No |
| 562 | K -> R | No |
| 609 | S -> | No |
| 636 | A -> V | No |
| 647 | S -> R | No |
| 647 | S -> | No |
| 691 | P -> | No |
| 737 | T -> P | No |
| 753 | V -> | No |
| 796 | N -> Y | No |

The glycosylation sites of variant protein T27396_PEA_1_P10 (SEQ ID NO:341), as compared to the known protein Suppressor of tumorigenicity 14 (SEQ ID NO:338), are described in Table 351 (given according to their position(s) on the amino acid sequence in the first column; the second column indicates whether the glycosylation site is present in the variant protein; and the last column indicates whether the position is different on the variant protein).

TABLE 351

Glycosylation site(s)

| Position(s) on known amino acid sequence | Present in variant protein? | Position in variant protein? |
|---|---|---|
| 485 | yes | 485 |
| 772 | yes | 734 |
| 302 | yes | 302 |
| 109 | yes | 109 |

Variant protein T27396_PEA_1_P10 (SEQ ID NO:341) is encoded by the following transcript(s): T27396_PEA_1_T9 (SEQ ID NO:284), for which the sequence(s) is/are given at the end of the application. The coding portion of transcript T27396_PEA_1_T9 (SEQ ID NO:284) is shown in bold; this coding portion starts at position 211 and ends at position 2661. The transcript also has the following SNPs as listed in Table 352 (given according to their position on the nucleotide sequence, with the alternative nucleic acid listed; the last column indicates whether the SNP is known or not; the presence of known SNPs in variant protein T27396_PEA_1_P10 (SEQ ID NO:341) sequence provides support for the deduced sequence of this variant protein according to the present invention).

TABLE 352

Nucleic acid SNPs

| SNP position on nucleotide sequence | Alternative nucleic acid | Previously known SNP? |
|---|---|---|
| 206 | G -> T | No |
| 207 | G -> T | No |
| 420 | G -> | No |
| 464 | G -> A | No |
| 741 | C -> A | No |
| 950 | C -> | No |
| 956 | G -> | No |
| 1029 | C -> | No |
| 1077 | C -> | No |
| 1077 | C -> A | No |
| 1254 | G -> | No |
| 1254 | G -> T | No |
| 1351 | C -> A | No |
| 1425 | T -> C | No |
| 1816 | T -> C | No |
| 1839 | C -> T | No |
| 1895 | A -> G | No |
| 2035 | T -> | No |
| 2117 | C -> T | No |
| 2151 | C -> | No |
| 2151 | C -> G | No |
| 2281 | C -> | No |
| 2419 | A -> C | No |
| 2469 | G -> | No |
| 2596 | A -> T | No |
| 2694 | G -> A | No |
| 2695 | C -> A | No |
| 2714 | C -> | No |
| 2714 | C -> A | No |
| 2904 | A -> | No |
| 2904 | A -> C | No |
| 2939 | A -> C | No |
| 2949 | G -> A | No |
| 2963 | T -> C | No |
| 2983 | G -> C | No |
| 2986 | A -> G | No |
| 3011 | A -> G | No |
| 3045 | C -> T | No |
| 3054 | G -> | No |
| 3063 | G -> | No |
| 3189 | T -> A | No |

Variant protein T27396_PEA_1_P12 (SEQ ID NO:342) according to the present invention has an amino acid sequence as given at the end of the application; it is encoded by transcript(s) T27396_PEA_1_T11 (SEQ ID NO:285). An alignment is given to the known protein (Suppressor of tumorigenicity 14 (SEQ ID NO:338)) at the end of the application. One or more alignments to one or more previously published protein sequence are given at the end of the application. A brief description of the relationship of the variant protein according to the present invention to each such aligned protein is as follows:

Comparison report between T27396_PEA_1_P12 (SEQ ID NO:342) and ST14_HUMAN (SEQ ID NO:594):

1. An isolated chimeric polypeptide encoding for T27396_PEA_1_P12 (SEQ ID NO:342), comprising a first amino acid sequence being at least 90% homologous to MGSDRARKGGGGPKDFGAGLKYNSRHEK-VNGLEEGVEFLPVNNVKKVEKHGPGRWVV LAAV-LIGLLLVLLGIGFLVWHLQYRD-VRVQKVFNGYMRITNENFVDAYENSNSTEFVSLA SKVKDALKLLYSGVPFLGPYHKESAV-TAFSEGSVIAYYWSEFSIPQHLVEEAERVMAEER VVMLPPRARSLKSFVVTSVVAFPTDSK-TVQRTQDNSCSFGLHARGVELMRFTTPGFPDSP YPA-HARCQWALRGDADSVLSLTFRSFDLAS-CDERGSDLVTVYNTLSPMEPHALVQLCGT YPPSYNLTFHSSQNVLLITLITNTER-RHPGFEATFFQLPRMSSCGGRLRKAQGTFNSPYYPG HYPPNIDCTWNIEVPNNQHVKVRFK-
FFYLLEPGVPAGTCPKDYVEINGEKYCGERSQFVV
TSNSNKITVRFHSDQSYTDTGFLAEYL-
SYDSSDPCPGQFTCRTGRCIRKELRCDGWADCTD
HSDELNCSCDAGHQFTCKNKFCKPLF-
WVCDSVNDCGDNSDEQGCSCPAQTFRCSNGKCL
SKSQQCNGKDDCGDGSDEASCPKVNV-
VTCTKHTYRCLNGLCLSKGNPECDGKEDCSDGS
DEKDCDCGLRSFTRQARVVGGTDADE-
GEWPWQVSLHALGQGHICGASLISPNWLVSAA HCY-
IDDRGFRYSDPTQWTAFLGLHDQSQR-
SAPGVQERRLKRIISHPFFNDFTFDYDIALLE
LEKPAEYSSMVRPICLPDASHVFPAG-
KAIWVTGWGHTQYGG corresponding to amino acids 1-757 of ST14_HUMAN (SEQ ID NO:594), which also corresponds to amino acids 1-757 of T27396_PEA__1_P12 (SEQ ID NO:342), and a second amino acid sequence being at least 70%, optionally at least 80%, preferably at least 85%, more preferably at least 90% and most preferably at least 95% homologous to a polypeptide having the sequence GCYCQSPLSRRGLPVCQPRASALFQSFLVQ (SEQ ID NO:597) corresponding to amino acids 758-787 of T27396_PEA__1_P12 (SEQ ID NO:342), wherein said first amino acid sequence and second amino acid sequence are contiguous and in a sequential order.

2. An isolated polypeptide encoding for a tail of T27396_PEA__1_P12 (SEQ ID NO:342), comprising a polypeptide being at least 70%, optionally at least about 80%, preferably at least about 85%, more preferably at least about 90% and most preferably at least about 95% homologous to the sequence GCYCQSPLSRRGLPVCQPRASALFQSFLVQ (SEQ ID NO:597) in T27396_PEA__1_P12 (SEQ ID NO:342).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T27396_PEA__1_P12 (SEQ ID NO:342) also has the following non-silent SNPs (Single Nucleotide Polymorphisms) as listed in Table 353, (given according to their position(s) on the amino acid sequence, with the alternative amino acid(s) listed; the last column indicates whether the SNP is known or not; the presence of known SNPs in variant protein T27396_PEA__1_P12 (SEQ ID NO:342) sequence provides support for the deduced sequence of this variant protein according to the present invention).

TABLE 353

Amino acid mutations

| SNP position(s) on amino acid sequence | Alternative amino acid(s) | Previously known SNP? |
|---|---|---|
| 70 | L -> | No |
| 85 | R -> H | No |
| 247 | A -> | No |
| 249 | R -> | No |
| 273 | S -> | No |
| 289 | A -> | No |
| 348 | Q -> | No |
| 348 | Q -> H | No |
| 381 | R -> S | No |
| 574 | C -> R | No |

TABLE 353-continued

Amino acid mutations

| SNP position(s) on amino acid sequence | Alternative amino acid(s) | Previously known SNP? |
|---|---|---|
| 600 | K -> R | No |
| 647 | S -> | No |
| 674 | A -> V | No |
| 685 | S -> | No |
| 685 | S -> R | No |
| 729 | P -> | No |
| 779 | A -> G | No |

The glycosylation sites of variant protein T27396_PEA__1_P12 (SEQ ID NO:342), as compared to the known protein Suppressor of tumorigenicity 14 (SEQ ID NO:338), are described in Table 354 (given according to their position(s) on the amino acid sequence in the first column; the second column indicates whether the glycosylation site is present in the variant protein; and the last column indicates whether the position is different on the variant protein).

TABLE 354

Glycosylation site(s)

| Position(s) on known amino acid sequence | Present in variant protein? | Position in variant protein? |
|---|---|---|
| 485 | yes | 485 |
| 772 | no | |
| 302 | yes | 302 |
| 109 | yes | 109 |

Variant protein T27396_PEA__1_P12 (SEQ ID NO:342) is encoded by the following transcript(s): T27396_PEA__1_T11 (SEQ ID NO:285), for which the sequence(s) is/are given at the end of the application. The coding portion of transcript T27396_PEA__1_T11 (SEQ ID NO:285) is shown in bold; this coding portion starts at position 211 and ends at position 2571. The transcript also has the following SNPs as listed in Table 355 (given according to their position on the nucleotide sequence, with the alternative nucleic acid listed; the last column indicates whether the SNP is known or not; the presence of known SNPs in variant protein T27396_PEA__1_P12 (SEQ ID NO:342) sequence provides support for the deduced sequence of this variant protein according to the present invention).

TABLE 355

Nucleic acid SNPs

| SNP position on nucleotide sequence | Alternative nucleic acid | Previously known SNP? |
|---|---|---|
| 206 | G -> T | No |
| 207 | G -> T | No |
| 420 | G -> | No |
| 464 | G -> A | No |
| 741 | C -> A | No |
| 950 | C -> | No |
| 956 | G -> | No |
| 1029 | C -> | No |
| 1077 | C -> | No |
| 1077 | C -> A | No |
| 1254 | G -> | No |
| 1254 | G -> T | No |
| 1351 | C -> A | No |
| 1425 | T -> C | No |
| 1930 | T -> C | No |

TABLE 355-continued

Nucleic acid SNPs

| SNP position on nucleotide sequence | Alternative nucleic acid | Previously known SNP? |
|---|---|---|
| 1953 | C -> T | No |
| 2009 | A -> G | No |
| 2149 | T -> | No |
| 2231 | C -> T | No |
| 2265 | C -> | No |
| 2265 | C -> G | No |
| 2395 | C -> | No |
| 2546 | C -> G | No |
| 2702 | A -> C | No |
| 2752 | G -> | No |
| 2879 | A -> T | No |
| 2977 | G -> A | No |
| 2978 | C -> A | No |
| 2997 | C -> | No |
| 2997 | C -> A | No |
| 3187 | A -> | No |
| 3187 | A -> C | No |
| 3222 | A -> C | No |
| 3232 | G -> A | No |
| 3246 | T -> C | No |
| 3266 | G -> C | No |
| 3269 | A -> G | No |
| 3294 | A -> G | No |
| 3328 | C -> T | No |
| 3337 | G -> | No |
| 3346 | G -> | No |
| 3472 | T -> A | No |

Variant protein T27396_PEA_1_P13 (SEQ ID NO:343) according to the present invention has an amino acid sequence as given at the end of the application; it is encoded by transcript(s) T27396_PEA_1_T12 (SEQ ID NO:286). An alignment is given to the known protein (Suppressor of tumorigenicity 14 (SEQ ID NO:338)) at the end of the application. One or more alignments to one or more previously published protein sequences are given at the end of the application. A brief description of the relationship of the variant protein according to the present invention to each such aligned protein is as follows:

Comparison report between T27396_PEA_1_P13 (SEQ ID NO:343) and ST14_HUMAN (SEQ ID NO:594):

1. An isolated chimeric polypeptide encoding for T27396_PEA_1_P13 (SEQ ID NO:343), comprising a first amino acid sequence being at least 90% homologous to MGSDRARKGGGGPKDFGAGLKYNSRHEK-VNGLEEGVEFLPVNNVKKVEKHGPGRWVV LAAV-LIGLLLVLLGIGFLVWHLQYRD-VRVQKVFNGYMRITNENFVDAYENSNSTEFVSLA SKVKDALKLLYSGVPFLGPYHKESAV-TAFSEGSVIAYYWSEFSIPQHLVEEAERVMAEER VVMLPPRARSLKSFVVTSVVAFPTDSK-TVQRTQDNSCSFGLHARGVELMRFTTPGFPDSP YPA-HARCQWALRGDADSVLSLTFRSFDLAS-CDERGSDLVTVYNTLSPMEPHALVQLCGT YPPSYNLTFHSSQNVLLITLITNTER-RHPGFEATFFQLPRMSSCGGRLRKAQGTFNSPYYPG HYPPNIDCTWNIEVPNNQHVKVRFK-FFYLLEPGVPAGTCPKDYVEINGEKYCGERSQFVV TSNSNKITVRFHSDQSYTDTGFLAEYL-SYDSSDPCPGQFTCRTGRCIRKELRCDGWADCTD HSDELNCSCDAGHQFTCKNKFCKPLF-WVCDSVNDCGDNSDEQGCSCPAQTFRCSNGKCL SKSQQCNGKDDCGDGSDEASCPKVNV-VTCTKHTYRCLNGLCLSKGNPECDGKEDCSDGS DEKDCDCGLRSFTRQARVVGGTDADE-GEWPWQVSLHALGQGHICGASLISPNWLVSAA HCY-IDDRGFR corresponding to amino acids 1-665 of ST14_HUMAN (SEQ ID NO:594), which also corresponds to amino acids 1-665 of T27396_PEA_1_P13 (SEQ ID NO:343), and a second amino acid sequence being at least 70%, optionally at least 80%, preferably at least 85%, more preferably at least 90% and most preferably at least 95% homologous to a polypeptide having the sequence PHAVDG-LPGLARPEPAQRPWGAGAQAQAHHLPPLLQ (SEQ ID NO:598) corresponding to amino acids 666-701 of T27396_PEA_1_P13 (SEQ ID NO:343), wherein said first amino acid sequence and second amino acid sequence are contiguous and in a sequential order.

2. An isolated polypeptide encoding for a tail of T27396_PEA_1_P13 (SEQ ID NO:343), comprising a polypeptide being at least 70%, optionally at least about 80%, preferably at least about 85%, more preferably at least about 90% and most preferably at least about 95% homologous to the sequence PHAVDGLPGLARPEPAQRPW-GAGAQAQAHHLPPLLQ (SEQ ID NO:598) in T27396_PEA_1_P13 (SEQ ID NO:343).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T27396_PEA_1_P13 (SEQ ID NO:343) also has the following non-silent SNPs (Single Nucleotide Polymorphisms) as listed in Table 356, (given according to their position(s) on the amino acid sequence, with the alternative amino acid(s) listed; the last column indicates whether the SNP is known or not; the presence of known SNPs in variant protein T27396_PEA_1_P13 (SEQ ID NO:343) sequence provides support for the deduced sequence of this variant protein according to the present invention).

TABLE 356

Amino acid mutations

| SNP position(s) on amino acid sequence | Alternative amino acid(s) | Previously known SNP? |
|---|---|---|
| 70 | L -> | No |
| 85 | R -> H | No |
| 247 | A -> | No |
| 249 | R -> | No |
| 273 | S -> | No |
| 289 | A -> | No |
| 348 | Q -> | No |
| 348 | Q -> H | No |
| 381 | R -> S | No |
| 574 | C -> R | No |
| 600 | K -> R | No |
| 647 | S -> | No |
| 683 | R -> | No |
| 683 | R -> G | No |

The glycosylation sites of variant protein T27396_PEA_1_P13 (SEQ ID NO:343), as compared to the known protein Suppressor of tumorigenicity 14 (SEQ ID NO:338), are described in Table 357 (given according to their position(s) on the amino acid sequence in the first column; the second column indicates whether the glycosylation site is present in the variant protein; and the last column indicates whether the position is different on the variant protein).

TABLE 357

Glycosylation site(s)

| Position(s) on known amino acid sequence | Present in variant protein? | Position in variant protein? |
|---|---|---|
| 485 | yes | 485 |
| 772 | no | |
| 302 | yes | 302 |
| 109 | yes | 109 |

Variant protein T27396_PEA_1_P13 (SEQ ID NO:343) is encoded by the following transcript(s): T27396_PEA_1_T12 (SEQ ID NO:286), for which the sequence(s) is/are given at the end of the application. The coding portion of transcript T27396_PEA_1_T12 (SEQ ID NO:86) is shown in bold; this coding portion starts at position 211 and ends at position 2313. The transcript also has the following SNPs as listed in Table 358 (given according to their position on the nucleotide sequence, with the alternative nucleic acid listed; the last column indicates whether the SNP is known or not; the presence of known SNPs in variant protein T27396_PEA_1_P13 SEQ ID NO:343) sequence provides support for the deduced sequence of this variant protein according to the present invention).

TABLE 358

Nucleic acid SNPs

| SNP position on nucleotide sequence | Alternative nucleic acid | Previously known SNP? |
|---|---|---|
| 206 | G -> T | No |
| 207 | G -> T | No |
| 420 | G -> | No |
| 464 | G -> A | No |
| 741 | C -> A | No |
| 950 | C -> | No |
| 956 | G -> | No |
| 1029 | C -> | No |
| 1077 | C -> | No |
| 1077 | C -> A | No |
| 1254 | G -> | No |
| 1254 | G -> T | No |
| 1351 | C -> A | No |
| 1425 | T -> C | No |
| 1930 | T -> C | No |
| 1953 | C -> T | No |
| 2009 | A -> G | No |
| 2149 | T -> | No |
| 2223 | C -> T | No |
| 2257 | C -> | No |
| 2257 | C -> G | No |
| 2387 | C -> | No |
| 2525 | A -> C | No |
| 2575 | G -> | No |
| 2702 | A -> T | No |
| 2800 | G -> A | No |
| 2801 | C -> A | No |
| 2820 | C -> | No |
| 2820 | C -> A | No |
| 3010 | A -> | No |
| 3010 | A -> C | No |
| 3045 | A -> C | No |
| 3055 | G -> A | No |
| 3069 | T -> C | No |
| 3089 | G -> C | No |
| 3092 | A -> G | No |
| 3117 | A -> G | No |
| 3151 | C -> T | No |
| 3160 | G -> | No |
| 3169 | G -> | No |
| 3295 | T -> A | No |

Variant protein T27396_PEA_1_P14 (SEQ ID NO:344) according to the present invention has an amino acid sequence as given at the end of the application; it is encoded by transcript(s) T27396_PEA_1_T13 (SEQ ID NO:287). An alignment is given to the known protein (Suppressor of tumorigenicity 14 (SEQ ID NO:338)) at the end of the application. One or more alignments to one or more previously published protein sequences are given at the end of the application. A brief description of the relationship of the variant protein according to the present invention to each such aligned protein is as follows:

Comparison report between T27396_PEA_1_P14 (SEQ ID NO:344) and ST14_HUMAN SEQ ID NO:594):

1. An isolated chimeric polypeptide encoding for T27396_PEA_1_P14 (SEQ ID NO:344), comprising a first amino acid sequence being at least 90% homologous to MGSDRARKGGGGPKDFGAGLKYNSRHEK-VNGLEEGVEFLPVNNVKKVEKHGPGRWVV LAAV-LIGLLLVLLGIGFLVWHLQYRD-VRVQKVFNGYMRITNENFVDAYENSNSTEFVSLA SKVKDALKLLYSGVPFLGPYHKESAV-TAFSEGSVIAYYWSEFSIPQHLVEEAERVMAEER VVMLPPRARSLKSFVVTSVVAFPTDSK-TVQRTQDNSCSFGLHARGVELMRFTTPGFPDSP YPA-HARCQWALRGDADSVLSLTFRSFDLAS-CDERGSDLVTVYNTLSPMEPHALVQLCGT YPPSYNLTFHSSQNVLLITLITNTER-RHPGFEATFFQLPRMSSCGGRLRKAQGTFNSPYYPG HYPPNIDCTWNIEVPNNQHVKVRFK-FFYLLEPGVPAGTCPKDYVEINGEKYCGERSQFVV TSNSNKITVRFHSDQSYTDTGFLAEYL-SYDSSDPCPGQFTCRTGRCIRKELRCDGWADCTD HSDELNCSCDAGHQFTCKNKFCKPLF-WVCDSVNDCGDNSDEQGCSCPAQTFRCSNGKCL SKSQQCNGKDDCGDGSDEASCPKVNV-VTCTKHTYRCLNGLCLSKGNPECDGKEDCSDGS DEKDCDCGLRSFTRQARVVGGTDADE-GEWPWQVSLHALGQGHICGASLISPNWLVSAA HCY-IDDRGFRYSDPTQWTAFLGLHDQSQR-SAPGVQERRLKRIISHPFFNDFTFDYDIALLE LEKPAEYSSMVRPICLPDASHVFPAG-KAIWVTGWGHTQYGGTGALILQKGEIRVINQTTC ENLLPQQITPRMM corresponding to amino acids 1-789 of ST14_HUMAN (SEQ ID NO:594), which also corresponds to amino acids 1-789 of T27396_PEA_1_P14 (SEQ ID NO:344), and a second amino acid sequence being at least 70%, optionally at least 80%, preferably at least 85%, more preferably at least 90% and most preferably at least 95% homologous to a polypeptide having the sequence VIPGD-PCPAWRRMGGSSRPVW (SEQ ID NO:599) corresponding to amino acids 790-810 of T27396_PEA_1_P14 (SEQ ID NO:344), wherein said first amino acid sequence and second amino acid sequence are contiguous and in a sequential order.

2. An isolated polypeptide encoding for a tail of T27396_PEA_1_P14 (SEQ ID NO:344), comprising a polypeptide being at least 70%, optionally at least about 80%, preferably at least about 85%, more preferably at least about 90% and most preferably at least about 95% homologous to the sequence VIPGDPCPAWRRMGGSSRPVW (SEQ ID NO:599) in T27396_PEA_1_P14 (SEQ ID NO:344).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T27396_PEA_1_P14 (SEQ ID NO:344) also has the following non-silent SNPs (Single Nucleotide Polymorphisms) as listed in Table 359, (given according to their position(s) on the amino acid sequence, with the alternative amino acid(s) listed; the last column indicates whether the SNP is known or not; the presence of known SNPs in variant protein T27396_PEA_1_P14 (SEQ ID NO:344) sequence provides support for the deduced sequence of this variant protein according to the present invention).

TABLE 359

Amino acid mutations

| SNP position(s) on amino acid sequence | Alternative amino acid(s) | Previously known SNP? |
|---|---|---|
| 70 | L -> | No |
| 85 | R -> H | No |
| 247 | A -> | No |
| 249 | R -> | No |
| 273 | S -> | No |
| 289 | A -> | No |
| 348 | Q -> | No |
| 348 | Q -> H | No |
| 381 | R -> S | No |
| 574 | C -> R | No |
| 600 | K -> R | No |
| 647 | S -> | No |
| 674 | A -> V | No |
| 685 | S -> | No |
| 685 | S -> R | No |
| 729 | P -> | No |
| 775 | T -> P | No |

The glycosylation sites of variant protein T27396_PEA_1_P14 (SEQ ID NO:344), as compared to the known protein Suppressor of tumorigenicity 14 (SEQ ID NO:338), are described in Table 360 (given according to their position(s) on the amino acid sequence in the first column; the second column indicates whether the glycosylation site is present in the variant protein; and the last column indicates whether the position is different on the variant protein).

TABLE 360

Glycosylation site(s)

| Position(s) on known amino acid sequence | Present in variant protein? | Position in variant protein? |
|---|---|---|
| 485 | yes | 485 |
| 772 | yes | 772 |
| 302 | yes | 302 |
| 109 | yes | 109 |

Variant protein T27396_PEA_1_P14 (SEQ ID NO:344) is encoded by the following transcript(s): T27396_PEA_1_T13 (SEQ ID NO:287), for which the sequence(s) is/are given at the end of the application. The coding portion of transcript T27396_PEA_1_T13 (SEQ ID NO:87) is shown in bold; this coding portion starts at position 211 and ends at position 2640. The transcript also has the following SNPs as listed in Table 361 (given according to their position on the nucleotide sequence, with the alternative nucleic acid listed; the last column indicates whether the SNP is known or not; the presence of known SNPs in variant protein T27396_PEA_1_P14 SEQ ID NO:344) sequence provides support for the deduced sequence of this variant protein according to the present invention).

TABLE 361

Nucleic acid SNPs

| SNP position on nucleotide sequence | Alternative nucleic acid | Previously known SNP? |
|---|---|---|
| 206 | G -> T | No |
| 207 | G -> T | No |
| 420 | G -> | No |
| 464 | G -> A | No |
| 741 | C -> A | No |
| 950 | C -> | No |
| 956 | G -> | No |
| 1029 | C -> | No |
| 1077 | C -> | No |
| 1077 | C -> A | No |
| 1254 | G -> | No |
| 1254 | G -> T | No |
| 1351 | C -> A | No |
| 1425 | T -> C | No |
| 1930 | T -> C | No |
| 1953 | C -> T | No |
| 2009 | A -> G | No |
| 2149 | T -> | No |
| 2231 | C -> T | No |
| 2265 | C -> | No |
| 2265 | C -> G | No |
| 2395 | C -> | No |
| 2533 | A -> C | No |
| 2670 | A -> T | No |
| 2768 | G -> A | No |
| 2769 | C -> A | No |
| 2788 | C -> | No |
| 2788 | C -> A | No |
| 2978 | A -> | No |
| 2978 | A -> C | No |
| 3013 | A -> C | No |
| 3023 | G -> A | No |
| 3037 | T -> C | No |
| 3057 | G -> C | No |
| 3060 | A -> G | No |
| 3085 | A -> G | No |
| 3119 | C -> T | No |
| 3128 | G -> | No |
| 3137 | G -> | No |
| 3263 | T -> A | No |

Variant protein T27396_PEA_1_P18 (SEQ ID NO:345) according to the present invention has an amino acid sequence as given at the end of the application; it is encoded by transcript(s) T27396_PEA_1_T20 (SEQ ID NO:289). An alignment is given to the known protein (Suppressor of tumorigenicity 14 (SEQ ID NO:338)) at the end of the application. One or more alignments to one or more previously published protein sequences are given at the end of the application. A brief description of the relationship of the variant protein according to the present invention to each such aligned protein is as follows:

Comparison report between T27396_PEA_1_P18 (SEQ ID NO:345) and ST14_HUMAN (SEQ ID NO:594):

1. An isolated chimeric polypeptide encoding for T27396_PEA_1_P18 (SEQ ID NO:345), comprising a first amino acid sequence being at least 90% homologous to MGSDRARKGGGGPKDFGAGLKYNSRHEK-VNGLEEGVEFLPVNNVKKVEKHGPGRWVV LAAV-LIGLLLVLLGIGFLVWHLQYRD-VRVQKVFNGYMRITNENFVDAYENSNSTEFVSLA SKVKDALKLLYSGVPFLGPYHKESAV-TAFSEGSVIAYYWSEFSIPQHLVEEAERVMAEER VVMLPPRARSLKSFVVTSVVAFPTDSK-TVQRTQDNSCSFGLHARGVELMRFTTPGFPDSP YPA- HARCQWALRGDADSVLSLTFRSFDLAS-
CDERGSDLVTVYNTLSPMEPHALVQLCGT
YPPSYNLTFHSSQNVLLITLITNTER-
RHPGFEATFFQLPRMSSCGGRLRKAQGTFNSPYYPG
HYPPNIDCTWNIEVPNNQHVKVRFK-
FFYLLEPGVPAGTCPKDYVEINGEKYCGERSQFVV
TSNSNKITVRFHSDQSYTDTGFLAEYL-
SYDSSDPCPGQFTCRTGRCIRKELRCDGWADCTD
HSDELNCSCDAGHQFTCKNKFCKPLF-
WVCDSVNDCGDNSDEQGCSCPAQTFRCSNGKCL
SKSQQCNGKDDCGDGSDEASCPKVNV-
VTCTKHTYRCLNGLCLSKGNPECDGKEDCSDGS
DEKDCDCGLRSFTRQARVVGGTDADE-
GEWPWQVSLHALGQGHICGASLISPNWLVSAA HCY-
IDDRGFRYSDPTQWTAFLGLHDQSQR-
SAPGVQERRLKRIISHPFFNDFTFDYDIALLE
LEKPAEYSSMVRPICLPDASHVFPAG-
KAIWVTGWGHTQYGG corresponding to amino acids 1-757 of ST14_HUMAN (SEQ ID NO:594), which also corresponds to amino acids 1-757 of T27396_PEA_1_P18 (SEQ ID NO:345).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T27396_PEA_1_P18 (SEQ ID NO:345) also has the following non-silent SNPs (Single Nucleotide Polymorphisms) as listed in Table 362, (given according to their position(s) on the amino acid sequence, with the alternative amino acid(s) listed; the last column indicates whether the SNP is known or not; the presence of known SNPs in variant protein T27396_PEA_1_P18 (SEQ ID NO:345) sequence provides support for the deduced sequence of this variant protein according to the present invention).

TABLE 362

Amino acid mutations

| SNP position(s) on amino acid sequence | Alternative amino acid(s) | Previously known SNP? |
|---|---|---|
| 70 | L -> | No |
| 85 | R -> H | No |
| 247 | A -> | No |
| 249 | R -> | No |
| 273 | S -> | No |
| 289 | A -> | No |
| 348 | Q -> | No |
| 348 | Q -> H | No |
| 381 | R -> S | No |
| 574 | C -> R | No |
| 600 | K -> R | No |
| 647 | S -> | No |
| 674 | A -> V | No |
| 685 | S -> | No |
| 685 | S -> R | No |
| 729 | P -> | No |

The glycosylation sites of variant protein T27396_PEA_1_P18 (SEQ ID NO:345), as compared to the known protein Suppressor of tumorigenicity 14 (SEQ ID NO:338), are described in Table 363 (given according to their position(s) on the amino acid sequence in the first column; the second column indicates whether the glycosylation site is present in the variant protein; and the last column indicates whether the position is different on the variant protein).

TABLE 363

Glycosylation site(s)

| Position(s) on known amino acid sequence | Present in variant protein? | Position in variant protein? |
|---|---|---|
| 485 | yes | 485 |
| 772 | no | |
| 302 | yes | 302 |
| 109 | yes | 109 |

Variant protein T27396_PEA_1_P18 (SEQ ID NO:345) is encoded by the following transcript(s): T27396_PEA_1_T20 (SEQ ID NO:289), for which the sequence(s) is/are given at the end of the application. The coding portion of transcript T27396_PEA_1_T20 (SEQ ID NO:289) is shown in bold; this coding portion starts at position 211 and ends at position 2481. The transcript also has the following SNPs as listed in Table 364 (given according to their position on the nucleotide sequence, with the alternative nucleic acid listed; the last column indicates whether the SNP is known or not; the presence of known SNPs in variant protein T27396_PEA_1_P18 SEQ ID NO:345) sequence provides support for the deduced sequence of this variant protein according to the present invention).

TABLE 364

Nucleic acid SNPs

| SNP position on nucleotide sequence | Alternative nucleic acid | Previously known SNP? |
|---|---|---|
| 206 | G -> T | No |
| 207 | G -> T | No |
| 420 | G -> | No |
| 464 | G -> A | No |
| 741 | C -> A | No |
| 950 | C -> | No |
| 956 | G -> | No |
| 1029 | C -> | No |
| 1077 | C -> | No |
| 1077 | C -> A | No |
| 1254 | G -> | No |
| 1254 | G -> T | No |
| 1351 | C -> A | No |
| 1425 | T -> C | No |
| 1930 | T -> C | No |
| 1953 | C -> T | No |
| 2009 | A -> G | No |
| 2149 | T -> | No |
| 2231 | C -> T | No |
| 2265 | C -> | No |
| 2265 | C -> G | No |
| 2395 | C -> | No |
| 2573 | A -> T | No |
| 2671 | G -> A | No |
| 2672 | C -> A | No |
| 2691 | C -> | No |
| 2691 | C -> A | No |
| 2881 | A -> | No |
| 2881 | A -> C | No |
| 2916 | A -> C | No |
| 2926 | G -> A | No |
| 2940 | T -> C | No |
| 2960 | G -> C | No |
| 2963 | A -> G | No |
| 2988 | A -> G | No |
| 3022 | C -> T | No |
| 3031 | G -> | No |
| 3040 | G -> | No |
| 3166 | T -> A | No |

Variant protein T27396_PEA_1_P24 (SEQ ID NO:346) according to the present invention has an amino acid sequence as given at the end of the application; it is encoded by transcript(s) T27396_PEA_1_T27 (SEQ ID NO:291). An alignment is given to the known protein (Suppressor of tumorigenicity 14 (SEQ ID NO:338)) at the end of the application. One or more alignments to one or more previously published protein sequences are given at the end of the application. A brief description of the relationship of the variant protein according to the present invention to each such aligned protein is as follows:

Comparison report between T27396_PEA_1_P24 (SEQ ID NO:346) and ST14_HUMAN (SEQ ID NO:594):

1. An isolated chimeric polypeptide encoding for T27396_PEA_1_P24 (SEQ ID NO:346), comprising a first amino acid sequence being at least 90% homologous to MGSDRARKGGGGPKDFGAGLKYNSRHEK-VNGLEEGVEFLPVNNVKK (SEQ ID NO:600) corresponding to amino acids 1-46 of ST14_HUMAN (SEQ ID NO:594), which also corresponds to amino acids 1-46 of T27396_PEA_1_P24 (SEQ ID NO:346), and a second amino acid sequence being at least 90% homologous to WTAFLGLHDQSQRSAPGVQERRLKRI-ISHPFFNDFTFDYDIALLELEKPAEYSSMVRPICLP DASHVFPAGKAIWVTGWGHTQYGGTGA-LILQKGEIRVINQTTCENLLPQQITPRMMCVGF LSG-GVDSCQGDSGGPLSSVEADGRIFQAGV-VSWGDGCAQRNKPGVYTRLPLFRDWIKEN TGV corresponding to amino acids 672-855 of ST14_HUMAN (SEQ ID NO:594), which also corresponds to amino acids 47-230 of T27396_PEA_1_P24 (SEQ ID NO:346), wherein said first amino acid sequence and second amino acid sequence are contiguous and in a sequential order.

2. An isolated chimeric polypeptide encoding for an edge portion of T27396_PEA_1_P24 (SEQ ID NO:346), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KW, having a structure as follows: a sequence starting from any of amino acid numbers 46-x to 46; and ending at any of amino acid numbers 47+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: intracellularly. The protein localization is believed to be intracellularly because of manual inspection of known protein localization and/or gene structure.

Variant protein T27396_PEA_1_P24 (SEQ ID NO:346) also has the following non-silent SNPs (Single Nucleotide Polymorphisms) as listed in Table 365, (given according to their position(s) on the amino acid sequence, with the alternative amino acid(s) listed; the last column indicates whether the SNP is known or not; the presence of known SNPs in variant protein T27396_PEA_1_P24 (SEQ ID NO:346) sequence provides support for the deduced sequence of this variant protein according to the present invention).

TABLE 365

Amino acid mutations

| SNP position(s) on amino acid sequence | Alternative amino acid(s) | Previously known SNP? |
|---|---|---|
| 49 | A -> V | No |
| 60 | S -> | No |
| 60 | S -> R | No |
| 104 | P -> | No |
| 150 | T -> P | No |
| 166 | V -> | No |
| 209 | N -> Y | No |

The glycosylation sites of variant protein T27396_PEA_1_P24 (SEQ ID NO:346), as compared to the known protein Suppressor of tumorigenicity 14 (SEQ ID NO:338), are described in Table 366 (given according to their position(s) on the amino acid sequence in the first column; the second column indicates whether the glycosylation site is present in the variant protein; and the last column indicates whether the position is different on the variant protein).

TABLE 366

Glycosylation site(s)

| Position(s) on known amino acid sequence | Present in variant protein? | Position in variant protein? |
|---|---|---|
| 485 | no | |
| 772 | yes | 147 |
| 302 | no | |
| 109 | no | |

Variant protein T27396_PEA_1_P24 (SEQ ID NO:346) is encoded by the following transcript(s): T27396_PEA_1_T27 (SEQ ID NO:291), for which the sequence(s) is/are given at the end of the application. The coding portion of transcript T27396_PEA_1_T27 (SEQ ID NO:291) is shown in bold; this coding portion starts at position 211 and ends at position 900. The transcript also has the following SNPs as listed in Table 367 (given according to their position on the nucleotide sequence, with the alternative nucleic acid listed; the last column indicates whether the SNP is known or not; the presence of known SNPs in variant protein T27396_PEA_1_P24 SEQ ID NO:346) sequence provides support for the deduced sequence of this variant protein according to the present invention).

TABLE 367

Nucleic acid SNPs

| SNP position on nucleotide sequence | Alternative nucleic acid | Previously known SNP? |
|---|---|---|
| 206 | G -> T | No |
| 207 | G -> T | No |
| 356 | C -> T | No |
| 390 | C -> | No |
| 390 | C -> G | No |
| 520 | C -> | No |
| 658 | A -> C | No |
| 708 | G -> | No |
| 835 | A -> T | No |
| 933 | G -> A | No |
| 934 | C -> A | No |
| 953 | C -> | No |
| 953 | C -> A | No |
| 1143 | A -> | No |
| 1143 | A -> C | No |

TABLE 367-continued

Nucleic acid SNPs

| SNP position on nucleotide sequence | Alternative nucleic acid | Previously known SNP? |
|---|---|---|
| 1178 | A -> C | No |
| 1188 | G -> A | No |
| 1202 | T -> C | No |
| 1222 | G -> C | No |
| 1225 | A -> G | No |
| 1250 | A -> G | No |
| 1284 | C -> T | No |
| 1293 | G -> | No |
| 1302 | G -> | No |
| 1428 | T -> A | No |

Variant protein T27396_PEA_1_P26 (SEQ ID NO:347) according to the present invention has an amino acid sequence as given at the end of the application; it is encoded by transcript(s) T27396_PEA_1_T29 (SEQ ID NO:292). An alignment is given to the known protein (Suppressor of tumorigenicity 14 (SEQ ID NO:338)) at the end of the application. One or more alignments to one or more previously published protein sequences are given at the end of the application. A brief description of the relationship of the variant protein according to the present invention to each such aligned protein is as follows:

Comparison report between T27396_PEA_1_P26 (SEQ ID NO:347) and ST14_HUMAN (SEQ ID NO:594):

1. An isolated chimeric polypeptide encoding for T27396_PEA_1_P26 (SEQ ID NO:347), comprising a first amino acid sequence being at least 90% homologous to MGSDRARKGGGGPKDFGAGLKYNSRHEK-VNGLEEGVEFLPVNNVKKVEKHGPGRWVV LAAV-LIGLLLVLLGIGFLVWHLQYRD-VRVQKVFNGYMRITNENFVDAYENSNSTEFVSLA SKVKDALKLLYSGVPFLGPYHKESAV-TAFSEGSVIAYYWSEFSIPQHLVEEAERVMAEER VVMLPPRARSLKSFVVTSVVAFPTDSK-TVQRTQDNSCSFGLHARGVELMRFTTPGFPDSP YPA-HARCQWALRGDADSVLSLTFRSFDLAS-CDERGSDLVTVYNTLSPMEPHALVQLCGT YPPSYNLTFHSSQNVLLITLITNTER-RHPGFEATFFQLPRMSSCGGRLRKAQGTFNSPYYPG HYPPNIDCTWNIEVPNNQHVKVRFK-FFYLLEPGVPAGTCPKDYVEINGEKYCGERSQFVV TSNSNKITVRFHSDQSYTDTGFLAEYL-SYDSSDPCPGQFTCRTGRCIRKELRCDGWADCTD HSDELNCSCDAGHQFTCKNKFCKPLF-WVCDSVNDCGDNSDEQGCSCPAQTFRCSNGKCL SKSQQCNGKDDCGDGSDEASCPKVNV-VTCTKHTYRCLNGLCLSKGNPECDGKEDCSDGS DEKDC corresponding to amino acids 1-602 of ST14_HUMAN (SEQ ID NO:594), which also corresponds to amino acids 1-602 of T27396_PEA_1_P26 (SEQ ID NO:347), and a second amino acid sequence being at least 70%, optionally at least 80%, preferably at least 85%, more preferably at least 90% and most preferably at least 95% homologous to a polypeptide having the sequence ELWP-SAFKGASPCSMLPPPL (SEQ ID NO:601) corresponding to amino acids 603-622 of T27396_PEA_1_P26 (SEQ ID NO:347), wherein said first amino acid sequence and second amino acid sequence are contiguous and in a sequential order.

2. An isolated polypeptide encoding for a tail of T27396_PEA_1_P26 (SEQ ID NO:347), comprising a polypeptide being at least 70%, optionally at least about 80%, preferably at least about 85%, more preferably at least about 90% and most preferably at least about 95% homologous to the sequence ELWPSAFKGASPCSMLPPPL (SEQ ID NO:601) in T27396_PEA_1_P26 (SEQ ID NO:347).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T27396_PEA_1_P26 (SEQ ID NO:347) also has the following non-silent SNPs (Single Nucleotide Polymorphisms) as listed in Table 368, (given according to their position(s) on the amino acid sequence, with the alternative amino acid(s) listed; the last column indicates whether the SNP is known or not; the presence of known SNPs in variant protein T27396_PEA_1_P26 (SEQ ID NO:347) sequence provides support for the deduced sequence of this variant protein according to the present invention).

TABLE 368

Amino acid mutations

| SNP position(s) on amino acid sequence | Alternative amino acid(s) | Previously known SNP? |
|---|---|---|
| 70 | L -> | No |
| 85 | R -> H | No |
| 247 | A -> | No |
| 249 | R -> | No |
| 273 | S -> | No |
| 289 | A -> | No |
| 348 | Q -> | No |
| 348 | Q -> H | No |
| 381 | R -> S | No |
| 574 | C -> R | No |
| 600 | K -> R | No |

The glycosylation sites of variant protein T27396_PEA_1_P26 (SEQ ID NO:347), as compared to the known protein Suppressor of tumorigenicity 14 (SEQ ID NO:338), are described in Table 369 (given according to their position(s) on the amino acid sequence in the first column; the second column indicates whether the glycosylation site is present in the variant protein; and the last column indicates whether the position is different on the variant protein).

TABLE 369

Glycosylation site(s)

| Position(s) on known amino acid sequence | Present in variant protein? | Position in variant protein? |
|---|---|---|
| 485 | yes | 485 |
| 772 | no | |
| 302 | yes | 302 |
| 109 | yes | 109 |

Variant protein T27396_PEA_1_P26 (SEQ ID NO:347) is encoded by the following transcript(s): T27396_PEA_1_T29 (SEQ ID NO:292), for which the sequence(s) is/are given at the end of the application. The coding portion of transcript T27396_PEA_1_T29 (SEQ ID NO:292) is shown in bold; this coding portion starts at position 211 and ends at position 2076. The transcript also has the following SNPs as listed in Table 370 (given according to their position on the nucleotide sequence, with the alternative nucleic acid listed; the last column indicates whether the SNP is known or not; the presence of known SNPs in variant protein T27396_PEA_1_P26 (SEQ ID NO:347) sequence provides support for the deduced sequence of this variant protein according to the present invention).

TABLE 370

Nucleic acid SNPs

| SNP position on nucleotide sequence | Alternative nucleic acid | Previously known SNP? |
|---|---|---|
| 206 | G -> T | No |
| 207 | G -> T | No |
| 420 | G -> | No |
| 464 | G -> A | No |
| 741 | C -> A | No |
| 950 | C -> | No |
| 956 | G -> | No |
| 1029 | C -> | No |
| 1077 | C -> | No |
| 1077 | C -> A | No |
| 1254 | G -> | No |
| 1254 | G -> T | No |
| 1351 | C -> A | No |
| 1425 | T -> C | No |
| 1930 | T -> C | No |
| 1953 | C -> T | No |
| 2009 | A -> G | No |

Variant protein T27396_PEA_1_P27 (SEQ ID NO:348) according to the present invention has an amino acid sequence as given at the end of the application; it is encoded by transcript(s) T27396_PEA_1_T30 (SEQ ID NO:293). An alignment is given to the known protein (Suppressor of tumorigenicity 14 (SEQ ID NO:338)) at the end of the application. One or more alignments to one or more previously published protein sequences are given at the end of the application. A brief description of the relationship of the variant protein according to the present invention to each such aligned protein is as follows:

Comparison report between T27396_PEA_1_P27 (SEQ ID NO:348) and ST14_HUMAN (SEQ ID NO:594):

1. An isolated chimeric polypeptide encoding for T27396_PEA_1_P27 (SEQ ID NO:348), comprising a first amino acid sequence being at least 90% homologous to MGSDRARKGGGGPKDFGAGLKYNSRHEK-VNGLEEGVEFLPVNNVKK corresponding to amino acids 1-46 of ST14_HUMAN (SEQ ID NO:594), which also corresponds to amino acids 1-46 of T27396_PEA_1_P27 (SEQ ID NO:348), a second amino acid sequence being at least 90% homologous to WTAFLGLHDQSQRSAPGVQER-RLKRIISHPFFNDFTFDYDIALLELE-KPAEYSSMVRPICLP DASHVFPAGKAIWVTG-WGHTQYGGTGALILQKGEIRVINQTTCENLLPQQITP RMMCVGF LSGGVDSCQ corresponding to amino acids 672-802 of ST14_HUMAN (SEQ ID NO:594), which also corresponds to amino acids 47-177 of T27396_PEA_1_P27 (SEQ ID NO:348), and a third amino acid sequence being at least 70%, optionally at least 80%, preferably at least 85%, more preferably at least 90% and most preferably at least 95% homologous to a polypeptide having the sequence VAPGAG-GRQVGPGRGGTGDSRQGLSPPRVIPGD-PCPAWRRMGGSSRPVW (SEQ ID NO:602) corresponding to amino acids 178-226 of T27396_PEA_1_P27 (SEQ ID NO:348), wherein said first amino acid sequence, second amino acid sequence and third amino acid sequence are contiguous and in a sequential order.

2. An isolated chimeric polypeptide encoding for an edge portion of T27396_PEA_1_P27 (SEQ ID NO:348), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KW, having a structure as follows: a sequence starting from any of amino acid numbers 46-x to 46; and ending at any of amino acid numbers 47+((n−2)−x), in which x varies from 0 to n−2.

3. An isolated polypeptide encoding for a tail of T27396_PEA_1_P27 (SEQ ID NO:348), comprising a polypeptide being at least 70%, optionally at least about 80%, preferably at least about 85%, more preferably at least about 90% and most preferably at least about 95% homologous to the sequence VAPGAGGRQVGPGRGGTGDSRQGLSP-PRVIPGDPCPAWRRMGGSSRPVW (SEQ ID NO:602) in T27396_PEA_1_P27 (SEQ ID NO:348).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because of manual inspection of known protein localization and/or gene structure.

Variant protein T27396_PEA_1_P27 (SEQ ID NO:348) also has the following non-silent SNPs (Single Nucleotide Polymorphisms) as listed in Table 371, (given according to their position(s) on the amino acid sequence, with the alternative amino acid(s) listed; the last column indicates whether the SNP is known or not; the presence of known SNPs in variant protein T27396_PEA_1_P27 (SEQ ID NO:348) sequence provides support for the deduced sequence of this variant protein according to the present invention).

TABLE 371

Amino acid mutations

| SNP position(s) on amino acid sequence | Alternative amino acid(s) | Previously known SNP? |
|---|---|---|
| 49 | A -> V | No |
| 60 | S -> | No |
| 60 | S -> R | No |
| 104 | P -> | No |
| 150 | T -> P | No |
| 166 | V -> | No |

The glycosylation sites of variant protein T27396_PEA_1_P27 (SEQ ID NO:348), as compared to the known protein Suppressor of tumorigenicity 14 (SEQ ID NO:338), are described in Table 372 (given according to their position(s) on the amino acid sequence in the first column; the second column indicates whether the glycosylation site is present in the variant protein; and the last column indicates whether the position is different on the variant protein).

TABLE 372

Glycosylation site(s)

| Position(s) on known amino acid sequence | Present in variant protein? | Position in variant protein? |
|---|---|---|
| 485 | no | |
| 772 | yes | 147 |

TABLE 372-continued

| Glycosylation site(s) | | |
|---|---|---|
| Position(s) on known amino acid sequence | Present in variant protein? | Position in variant protein? |
| 302 | no | |
| 109 | no | |

Variant protein T27396_PEA_1_P27 (SEQ ID NO:348) is encoded by the following transcript(s): T27396_PEA_1_T30 (SEQ ID NO:293), for which the sequence(s) is/are given at the end of the application. The coding portion of transcript T27396_PEA_1_T30 (SEQ ID NO:293) is shown in bold; this coding portion starts at position 211 and ends at position 888. The transcript also has the following SNPs as listed in Table 373 (given according to their position on the nucleotide sequence, with the alternative nucleic acid listed; the last column indicates whether the SNP is known or not; the presence of known SNPs in variant protein T27396_PEA_1_P27 SEQ ID NO:348) sequence provides support for the deduced sequence of this variant protein according to the present invention).

TABLE 373

| Nucleic acid SNPs | | |
|---|---|---|
| SNP position on nucleotide sequence | Alternative nucleic acid | Previously known SNP? |
| 206 | G -> T | No |
| 207 | G -> T | No |
| 356 | C -> T | No |
| 390 | C -> | No |
| 390 | C -> G | No |
| 520 | C -> | No |
| 658 | A -> C | No |
| 708 | G -> | No |
| 918 | A -> T | No |
| 1016 | G -> A | No |
| 1017 | C -> A | No |
| 1036 | C -> | No |
| 1036 | C -> A | No |
| 1226 | A -> | No |
| 1226 | A -> C | No |
| 1261 | A -> C | No |
| 1271 | G -> A | No |
| 1285 | T -> C | No |
| 1305 | G -> C | No |
| 1308 | A -> G | No |
| 1333 | A -> G | No |
| 1367 | C -> T | No |
| 1376 | G -> | No |
| 1385 | G -> | No |
| 1511 | T -> A | No |

Variant protein T27396_PEA_1_P30 (SEQ ID NO:349) according to the present invention has an amino acid sequence as given at the end of the application; it is encoded by transcript(s) T27396_PEA_1_T23 (SEQ ID NO:290). An alignment is given to the known protein (Suppressor of tumorigenicity 14 (SEQ ID NO:338)) at the end of the application. One or more alignments to one or more previously published protein sequences are given at the end of the application. A brief description of the relationship of the variant protein according to the present invention to each such aligned protein is as follows:

Comparison report between T27396_PEA_1_P30 (SEQ ID NO:349) and ST14_HUMAN (SEQ ID NO:594):

1. An isolated chimeric polypeptide encoding for T27396_PEA_1_P30 (SEQ ID NO:349), comprising a first amino acid sequence being at least 90% homologous to MGSDRARKGGGGPKDFGAGLKYNSRHEK-VNGLEEGVEFLPVNNVKKVEKHGPGRWVV LAAV-LIGLLLVLLGIGFLVWHLQYRD-VRVQKVFNGYMRITNENFVDAYENSNSTEFVSLA SKVKDALKLLYSGVPFLGPYHKESAV-TAFSEGSVIAYYWSEFSIPQHLVEEAERVMAEER VVMLPPRARSLKSFVVTSVVAFPTDSK-TVQRTQDNSCSFGLHARGVELMRFTTPGFPDSP YPA-HARCQWALRGDADSVLSLTFRSFDLAS-CDERGSDLVTVYNTLSPMEPHALVQLCGT YPPSYNLTFHSSQNVLLITLITNTER-RHPGFEATFFQLPRMSSCGGRLRKAQGTFNSPYYPG HYPPNIDCTWNIEVPNNQHVKVRFK-FFYLLEPGVPAGTCPKDYVEINGEKYCGERSQFVV TSNSNKITVRFHSDQSYTDTGFLAEYL-SYDSSDPCPGQFTCRTGRCIRkELRCDGWADCTD HSDELNCSCDAGHQFTCKNKFCKPLF-WVCDSVNDCGDNSDEQGCSCPAQTFRCSNGKCL SKSQQCNGKDDCGDGSDEASCPKVNV-VTCTKHTYRCLNGLCLSKGNPECDGKEDCSDGS DEKDCDCGLRSFTRQARVVGGTDADE-GEWPWQVSLHALGQGHICGASLISPNWLVSAA HCY-IDDRGFRYSDPTQWTAFLGLHDQSQR-SAPGVQERRLKRIISHPFFNDFTFDYDIALLE LEKPAEYSSMVRPICLPDASHVFPAG-KAIWVTGWGHTQYGGTGALILQKGEIRVINQTTC ENLLPQQITPRMMC corresponding to amino acids 1-790 of ST14_HUMAN (SEQ ID NO:594), which also corresponds to amino acids 1-790 of T27396_PEA_1_P30 (SEQ ID NO:349), and a second amino acid sequence being at least 70%, optionally at least 80%, preferably at least 85%, more preferably at least 90% and most preferably at least 95% homologous to a polypeptide having the sequence GGLQCVYLCK (SEQ ID NO:603) corresponding to amino acids 791-800 of T27396_PEA_1_P30 (SEQ ID NO:349), wherein said first amino acid sequence and second amino acid sequence are contiguous and in a sequential order.

2. An isolated polypeptide encoding for a tail of T27396_PEA_1_P30 (SEQ ID NO:349), comprising a polypeptide being at least 70%, optionally at least about 80%, preferably at least about 85%, more preferably at least about 90% and most preferably at least about 95% homologous to the sequence GGLQCVYLCK (SEQ ID NO:603) in T27396_PEA_1_P30 (SEQ ID NO:349).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T27396_PEA_1_P30 (SEQ ID NO:349) also has the following non-silent SNPs (Single Nucleotide Polymorphisms) as listed in Table 374, (given according to their position(s) on the amino acid sequence, with the alternative amino acid(s) listed; the last column indicates whether the SNP is known or not; the presence of known SNPs in variant protein T27396_PEA_1_P30 (SEQ ID NO:349) sequence provides support for the deduced sequence of this variant protein according to the present invention).

TABLE 374

Amino acid mutations

| SNP position(s) on amino acid sequence | Alternative amino acid(s) | Previously known SNP? |
|---|---|---|
| 70 | L -> | No |
| 85 | R -> H | No |
| 247 | A -> | No |
| 249 | R -> | No |
| 273 | S -> | No |
| 289 | A -> | No |
| 348 | Q -> | No |
| 348 | Q -> H | No |
| 381 | R -> S | No |
| 574 | C -> R | No |
| 600 | K -> R | No |
| 647 | S -> | No |
| 674 | A -> V | No |
| 685 | S -> | No |
| 685 | S -> R | No |
| 729 | P -> | No |
| 775 | T -> P | No |

The glycosylation sites of variant protein T27396_PEA_1_P30 (SEQ ID NO:349), as compared to the known protein Suppressor of tumorigenicity 14 (SEQ ID NO:338), are described in Table 375 (given according to their position(s) on the amino acid sequence in the first column; the second column indicates whether the glycosylation site is present in the variant protein; and the last column indicates whether the position is different on the variant protein).

TABLE 375

Glycosylation site(s)

| Position(s) on known amino acid sequence | Present in variant protein? | Position in variant protein? |
|---|---|---|
| 485 | yes | 485 |
| 772 | yes | 772 |
| 302 | yes | 302 |
| 109 | yes | 109 |

Variant protein T27396_PEA_1_P30 (SEQ ID NO:349) is encoded by the following transcript(s): T27396_PEA_1_T23 (SEQ ID NO:290), for which the sequence(s) is/are given at the end of the application. The coding portion of transcript T27396_PEA_1_T23 (SEQ ID NO:290) is shown in bold; this coding portion starts at position 211 and ends at position 2610. The transcript also has the following SNPs as listed in Table 376 (given according to their position on the nucleotide sequence, with the alternative nucleic acid listed; the last column indicates whether the SNP is known or not; the presence of known SNPs in variant protein T27396_PEA_1_P30 (SEQ ID NO:349) sequence provides support for the deduced sequence of this variant protein according to the present invention).

TABLE 376

Nucleic acid SNPs

| SNP position on nucleotide sequence | Alternative nucleic acid | Previously known SNP? |
|---|---|---|
| 206 | G -> T | No |
| 207 | G -> T | No |
| 420 | G -> | No |
| 464 | G -> A | No |
| 741 | C -> A | No |

TABLE 376-continued

Nucleic acid SNPs

| SNP position on nucleotide sequence | Alternative nucleic acid | Previously known SNP? |
|---|---|---|
| 950 | C -> | No |
| 956 | G -> | No |
| 1029 | C -> | No |
| 1077 | C -> | No |
| 1077 | C -> A | No |
| 1254 | G -> | No |
| 1254 | G -> T | No |
| 1351 | C -> A | No |
| 1425 | T -> C | No |
| 1930 | T -> C | No |
| 1953 | C -> T | No |
| 2009 | A -> G | No |
| 2149 | T -> | No |
| 2231 | C -> T | No |
| 2265 | C -> | No |
| 2265 | C -> G | No |
| 2395 | C -> | No |
| 2533 | A -> C | No |
| 2622 | T -> A | No |

As noted above, cluster T27396 features 44 segment(s), which were listed in Table 339 above and for which the sequence(s) are given at the end of the application. These segment(s) are portions of nucleic acid sequence(s) which are described herein separately because they are of particular interest. A description of each segment according to the present invention is now provided.

Segment cluster T27396_PEA_1_node_0 (SEQ ID NO:294) according to the present invention is supported by 37 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290), T27396_PEA_1_T27 (SEQ ID NO:291), T27396_PEA_1_T29 (SEQ ID NO:292) and T27396_PEA_1_T30 (SEQ ID NO:293). Table 377 below describes the starting and ending position of this segment on each transcript.

TABLE 377

Segment location on transcripts

| Transcript name | Segment starting position | Segment ending position |
|---|---|---|
| T27396_PEA_1_T2 (SEQ ID NO: 282) | 1 | 291 |
| T27396_PEA_1_T3 (SEQ ID NO: 283) | 1 | 291 |
| T27396_PEA_1_T9 (SEQ ID NO: 284) | 1 | 291 |
| T27396_PEA_1_T11 (SEQ ID NO: 285) | 1 | 291 |
| T27396_PEA_1_T12 (SEQ ID NO: 286) | 1 | 291 |
| T27396_PEA_1_T13 (SEQ ID NO: 287) | 1 | 291 |
| T27396_PEA_1_T19 (SEQ ID NO: 288) | 1 | 291 |
| T27396_PEA_1_T20 (SEQ ID NO: 289) | 1 | 291 |
| T27396_PEA_1_T23 (SEQ ID NO: 290) | 1 | 291 |

TABLE 377-continued

Segment location on transcripts

| Transcript name | Segment starting position | Segment ending position |
|---|---|---|
| T27396_PEA_1_T27 (SEQ ID NO: 291) | 1 | 291 |
| T27396_PEA_1_T29 (SEQ ID NO: 292) | 1 | 291 |
| T27396_PEA_1_T30 (SEQ ID NO: 293) | 1 | 291 |

Segment cluster T27396_PEA_1_node_19 (SEQ ID NO:295) according to the present invention is supported by 73 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 378 below describes the starting and ending position of this segment on each transcript.

TABLE 378

Segment location on transcripts

| Transcript name | Segment starting position | Segment ending position |
|---|---|---|
| T27396_PEA_1_T2 (SEQ ID NO: 282) | 833 | 1073 |
| T27396_PEA_1_T3 (SEQ ID NO: 283) | 896 | 1136 |
| T27396_PEA_1_T9 (SEQ ID NO: 284) | 845 | 1085 |
| T27396_PEA_1_T11 (SEQ ID NO: 285) | 845 | 1085 |
| T27396_PEA_1_T12 (SEQ ID NO: 286) | 845 | 1085 |
| T27396_PEA_1_T13 (SEQ ID NO: 287) | 845 | 1085 |
| T27396_PEA_1_T19 (SEQ ID NO: 288) | 845 | 1085 |
| T27396_PEA_1_T20 (SEQ ID NO: 289) | 845 | 1085 |
| T27396_PEA_1_T23 (SEQ ID NO: 290) | 845 | 1085 |
| T27396_PEA_1_T29 (SEQ ID NO: 292) | 845 | 1085 |

Segment cluster T27396_PEA_1_node_31 (SEQ ID NO:296) according to the present invention is supported by 68 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 379 below describes the starting and ending position of this segment on each transcript.

TABLE 379

Segment location on transcripts

| Transcript name | Segment starting position | Segment ending position |
|---|---|---|
| T27396_PEA_1_T2 (SEQ ID NO: 282) | 1422 | 1552 |
| T27396_PEA_1_T3 (SEQ ID NO: 283) | 1485 | 1615 |
| T27396_PEA_1_T9 (SEQ ID NO: 284) | 1434 | 1564 |
| T27396_PEA_1_T11 (SEQ ID NO: 285) | 1434 | 1564 |
| T27396_PEA_1_T12 (SEQ ID NO: 286) | 1434 | 1564 |
| T27396_PEA_1_T13 (SEQ ID NO: 287) | 1434 | 1564 |
| T27396_PEA_1_T19 (SEQ ID NO: 288) | 1434 | 1564 |
| T27396_PEA_1_T20 (SEQ ID NO: 289) | 1434 | 1564 |
| T27396_PEA_1_T23 (SEQ ID NO: 290) | 1434 | 1564 |
| T27396_PEA_1_T29 (SEQ ID NO: 292) | 1434 | 1564 |

Segment cluster T27396_PEA_1_node_43 (SEQ ID NO:297) according to the present invention is supported by 99 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 380 below describes the starting and ending position of this segment on each transcript.

TABLE 380

Segment location on transcripts

| Transcript name | Segment starting position | Segment ending position |
|---|---|---|
| T27396_PEA_1_T2 (SEQ ID NO: 282) | 1883 | 2005 |
| T27396_PEA_1_T3 (SEQ ID NO: 283) | 1946 | 2068 |
| T27396_PEA_1_T9 (SEQ ID NO: 284) | 1781 | 1903 |
| T27396_PEA_1_T11 (SEQ ID NO: 285) | 1895 | 2017 |
| T27396_PEA_1_T12 (SEQ ID NO: 286) | 1895 | 2017 |
| T27396_PEA_1_T13 (SEQ ID NO: 287) | 1895 | 2017 |
| T27396_PEA_1_T19 (SEQ ID NO: 288) | 1895 | 2017 |
| T27396_PEA_1_T20 (SEQ ID NO: 289) | 1895 | 2017 |
| T27396_PEA_1_T23 (SEQ ID NO: 290) | 1895 | 2017 |
| T27396_PEA_1_T29 (SEQ ID NO: 292) | 1895 | 2017 |

Segment cluster T27396_PEA_1_node_45 (SEQ ID NO:298) according to the present invention is supported by 1 libraries. The number of libraries was determined as previously described. This segment can be found in the following transcript(s): T27396_PEA_1_T29 (SEQ ID NO:292). Table 381 below describes the starting and ending position of this segment on each transcript.

TABLE 381

Segment location on transcripts

| Transcript name | Segment starting position | Segment ending position |
|---|---|---|
| T27396_PEA_1_T29 (SEQ ID NO: 292) | 2018 | 2159 |

Segment cluster T27396_PEA_1_node_49 (SEQ ID NO:299) according to the present invention is supported by 111 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289) and T27396_PEA_1_T23 (SEQ ID NO:290). Table 382 below describes the starting and ending position of this segment on each transcript.

TABLE 382

Segment location on transcripts

| Transcript name | Segment starting position | Segment ending position |
|---|---|---|
| T27396_PEA_1_T2 (SEQ ID NO: 282) | 2031 | 2192 |
| T27396_PEA_1_T3 (SEQ ID NO: 283) | 2094 | 2255 |
| T27396_PEA_1_T9 (SEQ ID NO: 284) | 1929 | 2090 |
| T27396_PEA_1_T11 (SEQ ID NO: 285) | 2043 | 2204 |
| T27396_PEA_1_T12 (SEQ ID NO: 286) | 2043 | 2204 |
| T27396_PEA_1_T13 (SEQ ID NO: 287) | 2043 | 2204 |
| T27396_PEA_1_T19 (SEQ ID NO: 288) | 2043 | 2204 |
| T27396_PEA_1_T20 (SEQ ID NO: 289) | 2043 | 2204 |
| T27396_PEA_1_T23 (SEQ ID NO: 290) | 2043 | 2204 |

Segment cluster T27396_PEA_1_node_55 (SEQ ID NO:300) according to the present invention is supported by 129 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290), T27396_PEA_1_T27 (SEQ ID NO:291) and T27396_PEA_1_T30 (SEQ ID NO:293). Table 383 below describes the starting and ending position of this segment on each transcript.

TABLE 383

Segment location on transcripts

| Transcript name | Segment starting position | Segment ending position |
|---|---|---|
| T27396_PEA_1_T2 (SEQ ID NO: 282) | 2212 | 2467 |
| T27396_PEA_1_T3 (SEQ ID NO: 283) | 2275 | 2530 |
| T27396_PEA_1_T9 (SEQ ID NO: 284) | 2110 | 2365 |
| T27396_PEA_1_T11 (SEQ ID NO: 285) | 2224 | 2479 |
| T27396_PEA_1_T12 (SEQ ID NO: 286) | 2216 | 2471 |
| T27396_PEA_1_T13 (SEQ ID NO: 287) | 2224 | 2479 |
| T27396_PEA_1_T19 (SEQ ID NO: 288) | 2224 | 2479 |
| T27396_PEA_1_T20 (SEQ ID NO: 289) | 2224 | 2479 |
| T27396_PEA_1_T23 (SEQ ID NO: 290) | 2224 | 2479 |
| T27396_PEA_1_T27 (SEQ ID NO: 291) | 349 | 604 |
| T27396_PEA_1_T30 (SEQ ID NO: 293) | 349 | 604 |

Segment cluster T27396_PEA_1_node_57 (SEQ ID NO:301) according to the present invention is supported by 10 libraries. The number of libraries was determined as previously described. This segment can be found in the following transcript(s): T27396_PEA_1_T11 (SEQ ID NO:285) and T27396_PEA_1_T19 (SEQ ID NO:288). Table 384 below describes the starting and ending position of this segment on each transcript.

TABLE 384

Segment location on transcripts

| Transcript name | Segment starting position | Segment ending position |
|---|---|---|
| T27396_PEA_1_T11 (SEQ ID NO: 285) | 2480 | 2648 |
| T27396_PEA_1_T19 (SEQ ID NO: 288) | 2480 | 2648 |

Segment cluster T27396_PEA_1_node_67 (SEQ ID NO:302) according to the present invention is supported by 200 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T27 (SEQ ID NO:291) and T27396_PEA_1_T30 (SEQ ID NO:293). Table 385 below describes the starting and ending position of this segment on each transcript.

TABLE 385

Segment location on transcripts

| Transcript name | Segment starting position | Segment ending position |
|---|---|---|
| T27396_PEA_1_T2 (SEQ ID NO: 282) | 2727 | 3103 |
| T27396_PEA_1_T3 (SEQ ID NO: 283) | 2790 | 3166 |
| T27396_PEA_1_T9 (SEQ ID NO: 284) | 2625 | 3001 |
| T27396_PEA_1_T11 (SEQ ID NO: 285) | 2908 | 3284 |
| T27396_PEA_1_T12 (SEQ ID NO: 286) | 2731 | 3107 |
| T27396_PEA_1_T13 (SEQ ID NO: 287) | 2699 | 3075 |
| T27396_PEA_1_T19 (SEQ ID NO: 288) | 2798 | 3174 |
| T27396_PEA_1_T20 (SEQ ID NO: 289) | 2602 | 2978 |
| T27396_PEA_1_T27 (SEQ ID NO: 291) | 864 | 1240 |
| T27396_PEA_1_T30 (SEQ ID NO: 293) | 947 | 1323 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 386.

TABLE 386

Oligonucleotides related to this segment

| Oligonucleotide name | Overexpressed in cancers | Chip reference |
|---|---|---|
| T27396_0_10_0 (SEQ ID NO: 516) | ovarian carcinoma | OVA |

The sequence for oligonucleotide T27396_0_10_0 (SEQ ID NO:516) is as follows: ACAAGGCTCCCTCT-GTTTCGGGACTGGATCAAAGAGAA-CACTGGGGTATA.

According to an optional embodiment of the present invention, short segments related to the above cluster are also provided. These segments are up to about 120 bp in length, and so are included in a separate description.

Segment cluster T27396_PEA_1_node_2 (SEQ ID NO:303) according to the present invention is supported by 36 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290), T27396_PEA_1_T27 (SEQ ID NO:291), T27396_PEA_1_T29 (SEQ ID NO:292) and T27396_PEA_1_T30 (SEQ ID NO:293). Table 387 below describes the starting and ending position of this segment on each transcript.

TABLE 387

Segment location on transcripts

| Transcript name | Segment starting position | Segment ending position |
|---|---|---|
| T27396_PEA_1_T2 (SEQ ID NO: 282) | 292 | 341 |
| T27396_PEA_1_T3 (SEQ ID NO: 283) | 292 | 341 |
| T27396_PEA_1_T9 (SEQ ID NO: 284) | 292 | 341 |
| T27396_PEA_1_T11 (SEQ ID NO: 285) | 292 | 341 |
| T27396_PEA_1_T12 (SEQ ID NO: 286) | 292 | 341 |
| T27396_PEA_1_T13 (SEQ ID NO: 287) | 292 | 341 |
| T27396_PEA_1_T19 (SEQ ID NO: 288) | 292 | 341 |
| T27396_PEA_1_T20 (SEQ ID NO: 289) | 292 | 341 |
| T27396_PEA_1_T23 (SEQ ID NO: 290) | 292 | 341 |
| T27396_PEA_1_T27 (SEQ ID NO: 291) | 292 | 341 |
| T27396_PEA_1_T29 (SEQ ID NO: 292) | 292 | 341 |
| T27396_PEA_1_T30 (SEQ ID NO: 293) | 292 | 341 |

Segment cluster T27396_PEA_1_node_3 (SEQ ID NO:304) according to the present invention can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290), T27396_PEA_1_T27 (SEQ ID NO:291), T27396_PEA_1_T29 (SEQ ID NO:292) and T27396_PEA_1_T30 (SEQ ID NO:293). Table 388 below describes the starting and ending position of this segment on each transcript.

TABLE 388

Segment location on transcripts

| Transcript name | Segment starting position | Segment ending position |
|---|---|---|
| T27396_PEA_1_T2 (SEQ ID NO: 282) | 342 | 348 |
| T27396_PEA_1_T3 (SEQ ID NO: 283) | 342 | 348 |
| T27396_PEA_1_T9 (SEQ ID NO: 284) | 342 | 348 |
| T27396_PEA_1_T11 (SEQ ID NO: 285) | 342 | 348 |
| T27396_PEA_1_T12 (SEQ ID NO: 286) | 342 | 348 |
| T27396_PEA_1_T13 (SEQ ID NO: 287) | 342 | 348 |
| T27396_PEA_1_T19 (SEQ ID NO: 288) | 342 | 348 |
| T27396_PEA_1_T20 (SEQ ID NO: 289) | 342 | 348 |
| T27396_PEA_1_T23 (SEQ ID NO: 290) | 342 | 348 |
| T27396_PEA_1_T27 (SEQ ID NO: 291) | 342 | 348 |
| T27396_PEA_1_T29 (SEQ ID NO: 292) | 342 | 348 |
| T27396_PEA_1_T30 (SEQ ID NO: 293) | 342 | 348 |

Segment cluster T27396_PEA_1_node_4 (SEQ ID NO:305) according to the present invention is supported by 45 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 389 below describes the starting and ending position of this segment on each transcript.

TABLE 389

Segment location on transcripts

| Transcript name | Segment starting position | Segment ending position |
| --- | --- | --- |
| T27396_PEA_1_T2 (SEQ ID NO: 282) | 349 | 451 |
| T27396_PEA_1_T3 (SEQ ID NO: 283) | 349 | 451 |
| T27396_PEA_1_T9 (SEQ ID NO: 284) | 349 | 451 |
| T27396_PEA_1_T11 (SEQ ID NO: 285) | 349 | 451 |
| T27396_PEA_1_T12 (SEQ ID NO: 286) | 349 | 451 |
| T27396_PEA_1_T13 (SEQ ID NO: 287) | 349 | 451 |
| T27396_PEA_1_T19 (SEQ ID NO: 288) | 349 | 451 |
| T27396_PEA_1_T20 (SEQ ID NO: 289) | 349 | 451 |
| T27396_PEA_1_T23 (SEQ ID NO: 290) | 349 | 451 |
| T27396_PEA_1_T29 (SEQ ID NO: 292) | 349 | 451 |

Segment cluster T27396_PEA_1_node_6 (SEQ ID NO:306) according to the present invention is supported by 52 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 390 below describes the starting and ending position of this segment on each transcript.

TABLE 390

Segment location on transcripts

| Transcript name | Segment starting position | Segment ending position |
| --- | --- | --- |
| T27396_PEA_1_T2 (SEQ ID NO: 282) | 452 | 567 |
| T27396_PEA_1_T3 (SEQ ID NO: 283) | 452 | 567 |
| T27396_PEA_1_T9 (SEQ ID NO: 284) | 452 | 567 |
| T27396_PEA_1_T11 (SEQ ID NO: 285) | 452 | 567 |
| T27396_PEA_1_T12 (SEQ ID NO: 286) | 452 | 567 |
| T27396_PEA_1_T13 (SEQ ID NO: 287) | 452 | 567 |

TABLE 390-continued

Segment location on transcripts

| Transcript name | Segment starting position | Segment ending position |
| --- | --- | --- |
| T27396_PEA_1_T19 (SEQ ID NO: 288) | 452 | 567 |
| T27396_PEA_1_T20 (SEQ ID NO: 289) | 452 | 567 |
| T27396_PEA_1_T23 (SEQ ID NO: 290) | 452 | 567 |
| T27396_PEA_1_T29 (SEQ ID NO: 292) | 452 | 567 |

Segment cluster T27396_PEA_1_node_7 (SEQ ID NO:307) according to the present invention can be found in the following transcript(s): T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 391 below describes the starting and ending position of this segment on each transcript.

TABLE 391

Segment location on transcripts

| Transcript name | Segment starting position | Segment ending position |
| --- | --- | --- |
| T27396_PEA_1_T3 (SEQ ID NO: 283) | 568 | 579 |
| T27396_PEA_1_T9 (SEQ ID NO: 284) | 568 | 579 |
| T27396_PEA_1_T11 (SEQ ID NO: 285) | 568 | 579 |
| T27396_PEA_1_T12 (SEQ ID NO: 286) | 568 | 579 |
| T27396_PEA_1_T13 (SEQ ID NO: 287) | 568 | 579 |
| T27396_PEA_1_T19 (SEQ ID NO: 288) | 568 | 579 |
| T27396_PEA_1_T20 (SEQ ID NO: 289) | 568 | 579 |
| T27396_PEA_1_T23 (SEQ ID NO: 290) | 568 | 579 |
| T27396_PEA_1_T29 (SEQ ID NO: 292) | 568 | 579 |

Segment cluster T27396_PEA_1_node_9 (SEQ ID NO:308) according to the present invention is supported by 52 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 392 below describes the starting and ending position of this segment on each transcript.

TABLE 392

Segment location on transcripts

| Transcript name | Segment starting position | Segment ending position |
|---|---|---|
| T27396_PEA_1_T2 (SEQ ID NO: 282) | 568 | 597 |
| T27396_PEA_1_T3 (SEQ ID NO: 283) | 580 | 609 |
| T27396_PEA_1_T9 (SEQ ID NO: 284) | 580 | 609 |
| T27396_PEA_1_T11 (SEQ ID NO: 285) | 580 | 609 |
| T27396_PEA_1_T12 (SEQ ID NO: 286) | 580 | 609 |
| T27396_PEA_1_T13 (SEQ ID NO: 287) | 580 | 609 |
| T27396_PEA_1_T19 (SEQ ID NO: 288) | 580 | 609 |
| T27396_PEA_1_T20 (SEQ ID NO: 289) | 580 | 609 |
| T27396_PEA_1_T23 (SEQ ID NO: 290) | 580 | 609 |
| T27396_PEA_1_T29 (SEQ ID NO: 292) | 580 | 609 |

Segment cluster T27396_PEA_1_node_10 (SEQ ID NO:309) according to the present invention is supported by 52 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 393 below describes the starting and ending position of this segment on each transcript.

TABLE 393

Segment location on transcripts

| Transcript name | Segment starting position | Segment ending position |
|---|---|---|
| T27396_PEA_1_T2 (SEQ ID NO: 282) | 598 | 638 |
| T27396_PEA_1_T3 (SEQ ID NO: 283) | 610 | 650 |
| T27396_PEA_1_T9 (SEQ ID NO: 284) | 610 | 650 |
| T27396_PEA_1_T11 (SEQ ID NO: 285) | 610 | 650 |
| T27396_PEA_1_T12 (SEQ ID NO: 286) | 610 | 650 |
| T27396_PEA_1_T13 (SEQ ID NO: 287) | 610 | 650 |
| T27396_PEA_1_T19 (SEQ ID NO: 288) | 610 | 650 |
| T27396_PEA_1_T20 (SEQ ID NO: 289) | 610 | 650 |
| T27396_PEA_1_T23 (SEQ ID NO: 290) | 610 | 650 |
| T27396_PEA_1_T29 (SEQ ID NO: 292) | 610 | 650 |

Segment cluster T27396_PEA_1_node_12 (SEQ ID NO:310) according to the present invention is supported by 55 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 394 below describes the starting and ending position of this segment on each transcript.

TABLE 394

Segment location on transcripts

| Transcript name | Segment starting position | Segment ending position |
|---|---|---|
| T27396_PEA_1_T2 (SEQ ID NO: 282) | 639 | 693 |
| T27396_PEA_1_T3 (SEQ ID NO: 283) | 651 | 705 |
| T27396_PEA_1_T9 (SEQ ID NO: 284) | 651 | 705 |
| T27396_PEA_1_T11 (SEQ ID NO: 285) | 651 | 705 |
| T27396_PEA_1_T12 (SEQ ID NO: 286) | 651 | 705 |
| T27396_PEA_1_T13 (SEQ ID NO: 287) | 651 | 705 |
| T27396_PEA_1_T19 (SEQ ID NO: 288) | 651 | 705 |
| T27396_PEA_1_T20 (SEQ ID NO: 289) | 651 | 705 |
| T27396_PEA_1_T23 (SEQ ID NO: 290) | 651 | 705 |
| T27396_PEA_1_T29 (SEQ ID NO: 292) | 651 | 705 |

Segment cluster T27396_PEA_1_node_13 (SEQ ID NO:311) according to the present invention is supported by 55 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 395 below describes the starting and ending position of this segment on each transcript.

TABLE 395

Segment location on transcripts

| Transcript name | Segment starting position | Segment ending position |
|---|---|---|
| T27396_PEA_1_T2 (SEQ ID NO: 282) | 694 | 796 |
| T27396_PEA_1_T3 (SEQ ID NO: 283) | 706 | 808 |
| T27396_PEA_1_T9 (SEQ ID NO: 284) | 706 | 808 |
| T27396_PEA_1_T11 (SEQ ID NO: 285) | 706 | 808 |
| T27396_PEA_1_T12 (SEQ ID NO: 286) | 706 | 808 |
| T27396_PEA_1_T13 (SEQ ID NO: 287) | 706 | 808 |
| T27396_PEA_1_T19 (SEQ ID NO: 288) | 706 | 808 |
| T27396_PEA_1_T20 (SEQ ID NO: 289) | 706 | 808 |
| T27396_PEA_1_T23 (SEQ ID NO: 290) | 706 | 808 |
| T27396_PEA_1_T29 (SEQ ID NO: 292) | 706 | 808 |

Segment cluster T27396_PEA_1_node_16 (SEQ ID NO:312) according to the present invention is supported by 56 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 396 below describes the starting and ending position of this segment on each transcript.

TABLE 396

Segment location on transcripts

| Transcript name | Segment starting position | Segment ending position |
|---|---|---|
| T27396_PEA_1_T2 (SEQ ID NO: 282) | 797 | 832 |
| T27396_PEA_1_T3 (SEQ ID NO: 283) | 809 | 844 |
| T27396_PEA_1_T9 (SEQ ID NO: 284) | 809 | 844 |
| T27396_PEA_1_T11 (SEQ ID NO: 285) | 809 | 844 |
| T27396_PEA_1_T12 (SEQ ID NO: 286) | 809 | 844 |
| T27396_PEA_1_T13 (SEQ ID NO: 287) | 809 | 844 |
| T27396_PEA_1_T19 (SEQ ID NO: 288) | 809 | 844 |
| T27396_PEA_1_T20 (SEQ ID NO: 289) | 809 | 844 |
| T27396_PEA_1_T23 (SEQ ID NO: 290) | 809 | 844 |
| T27396_PEA_1_T29 (SEQ ID NO: 292) | 809 | 844 |

Segment cluster T27396_PEA_1_node_18 (SEQ ID NO:313) according to the present invention is supported by 1 libraries. The number of libraries was determined as previously described. This segment can be found in the following transcript(s): T27396_PEA_1_T3 (SEQ ID NO:283). Table 397 below describes the starting and ending position of this segment on each transcript.

TABLE 397

Segment location on transcripts

| Transcript name | Segment starting position | Segment ending position |
|---|---|---|
| T27396_PEA_1_T3 (SEQ ID NO: 283) | 845 | 895 |

Segment cluster T27396_PEA_1_node_21 (SEQ ID NO:314) according to the present invention is supported by 55 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 398 below describes the starting and ending position of this segment on each transcript.

TABLE 398

Segment location on transcripts

| Transcript name | Segment starting position | Segment ending position |
|---|---|---|
| T27396_PEA_1_T2 (SEQ ID NO: 282) | 1074 | 1131 |
| T27396_PEA_1_T3 (SEQ ID NO: 283) | 1137 | 1194 |
| T27396_PEA_1_T9 (SEQ ID NO: 284) | 1086 | 1143 |
| T27396_PEA_1_T11 (SEQ ID NO: 285) | 1086 | 1143 |
| T27396_PEA_1_T12 (SEQ ID NO: 286) | 1086 | 1143 |
| T27396_PEA_1_T13 (SEQ ID NO: 287) | 1086 | 1143 |
| T27396_PEA_1_T19 (SEQ ID NO: 288) | 1086 | 1143 |
| T27396_PEA_1_T20 (SEQ ID NO: 289) | 1086 | 1143 |
| T27396_PEA_1_T23 (SEQ ID NO: 290) | 1086 | 1143 |
| T27396_PEA_1_T29 (SEQ ID NO: 292) | 1086 | 1143 |

Segment cluster T27396_PEA_1_node_22 (SEQ ID NO:315) according to the present invention can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 399 below describes the starting and ending position of this segment on each transcript.

TABLE 399

Segment location on transcripts

| Transcript name | Segment starting position | Segment ending position |
|---|---|---|
| T27396_PEA_1_T2 (SEQ ID NO: 282) | 1132 | 1139 |
| T27396_PEA_1_T3 (SEQ ID NO: 283) | 1195 | 1202 |
| T27396_PEA_1_T9 (SEQ ID NO: 284) | 1144 | 1151 |
| T27396_PEA_1_T11 (SEQ ID NO: 285) | 1144 | 1151 |
| T27396_PEA_1_T12 (SEQ ID NO: 286) | 1144 | 1151 |
| T27396_PEA_1_T13 (SEQ ID NO: 287) | 1144 | 1151 |
| T27396_PEA_1_T19 (SEQ ID NO: 288) | 1144 | 1151 |
| T27396_PEA_1_T20 (SEQ ID NO: 289) | 1144 | 1151 |
| T27396_PEA_1_T23 (SEQ ID NO: 290) | 1144 | 1151 |
| T27396_PEA_1_T29 (SEQ ID NO: 292) | 1144 | 1151 |

Segment cluster T27396_PEA_1_node_23 (SEQ ID NO:316) according to the present invention is supported by 60 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_

1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 400 below describes the starting and ending position of this segment on each transcript.

TABLE 400

Segment location on transcripts

| Transcript name | Segment starting position | Segment ending position |
|---|---|---|
| T27396_PEA_1_T2 (SEQ ID NO: 282) | 1140 | 1213 |
| T27396_PEA_1_T3 (SEQ ID NO: 283) | 1203 | 1276 |
| T27396_PEA_1_T9 (SEQ ID NO: 284) | 1152 | 1225 |
| T27396_PEA_1_T11 (SEQ ID NO: 285) | 1152 | 1225 |
| T27396_PEA_1_T12 (SEQ ID NO: 286) | 1152 | 1225 |
| T27396_PEA_1_T13 (SEQ ID NO: 287) | 1152 | 1225 |
| T27396_PEA_1_T19 (SEQ ID NO: 288) | 1152 | 1225 |
| T27396_PEA_1_T20 (SEQ ID NO: 289) | 1152 | 1225 |
| T27396_PEA_1_T23 (SEQ ID NO: 290) | 1152 | 1225 |
| T27396_PEA_1_T29 (SEQ ID NO: 292) | 1152 | 1225 |

Segment cluster T27396_PEA_1_node_25 (SEQ ID NO:317) according to the present invention is supported by 66 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 401 below describes the starting and ending position of this segment on each transcript.

TABLE 401

Segment location on transcripts

| Transcript name | Segment starting position | Segment ending position |
|---|---|---|
| T27396_PEA_1_T2 (SEQ ID NO: 282) | 1214 | 1311 |
| T27396_PEA_1_T3 (SEQ ID NO: 283) | 1277 | 1374 |
| T27396_PEA_1_T9 (SEQ ID NO: 284) | 1226 | 1323 |
| T27396_PEA_1_T11 (SEQ ID NO: 285) | 1226 | 1323 |
| T27396_PEA_1_T12 (SEQ ID NO: 286) | 1226 | 1323 |
| T27396_PEA_1_T13 (SEQ ID NO: 287) | 1226 | 1323 |
| T27396_PEA_1_T19 (SEQ ID NO: 288) | 1226 | 1323 |
| T27396_PEA_1_T20 (SEQ ID NO: 289) | 1226 | 1323 |
| T27396_PEA_1_T23 (SEQ ID NO: 290) | 1226 | 1323 |
| T27396_PEA_1_T29 (SEQ ID NO: 292) | 1226 | 1323 |

Segment cluster T27396_PEA_1_node_29 (SEQ ID NO:318) according to the present invention is supported by 59 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 402 below describes the starting and ending position of this segment on each transcript.

TABLE 402

Segment location on transcripts

| Transcript name | Segment starting position | Segment ending position |
|---|---|---|
| T27396_PEA_1_T2 (SEQ ID NO: 282) | 1312 | 1421 |
| T27396_PEA_1_T3 (SEQ ID NO: 283) | 1375 | 1484 |
| T27396_PEA_1_T9 (SEQ ID NO: 284) | 1324 | 1433 |
| T27396_PEA_1_T11 (SEQ ID NO: 285) | 1324 | 1433 |
| T27396_PEA_1_T12 (SEQ ID NO: 286) | 1324 | 1433 |
| T27396_PEA_1_T13 (SEQ ID NO: 287) | 1324 | 1433 |
| T27396_PEA_1_T19 (SEQ ID NO: 288) | 1324 | 1433 |
| T27396_PEA_1_T20 (SEQ ID NO: 289) | 1324 | 1433 |
| T27396_PEA_1_T23 (SEQ ID NO: 290) | 1324 | 1433 |
| T27396_PEA_1_T29 (SEQ ID NO: 292) | 1324 | 1433 |

Segment cluster T27396_PEA_1_node_34 (SEQ ID NO:319) according to the present invention is supported by 61 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 403 below describes the starting and ending position of this segment on each transcript.

TABLE 403

Segment location on transcripts

| Transcript name | Segment starting position | Segment ending position |
|---|---|---|
| T27396_PEA_1_T2 (SEQ ID NO: 282) | 1553 | 1657 |
| T27396_PEA_1_T3 (SEQ ID NO: 283) | 1616 | 1720 |
| T27396_PEA_1_T9 (SEQ ID NO: 284) | 1565 | 1669 |
| T27396_PEA_1_T11 (SEQ ID NO: 285) | 1565 | 1669 |
| T27396_PEA_1_T12 (SEQ ID NO: 286) | 1565 | 1669 |
| T27396_PEA_1_T13 (SEQ ID NO: 287) | 1565 | 1669 |

TABLE 403-continued

Segment location on transcripts

| Transcript name | Segment starting position | Segment ending position |
|---|---|---|
| T27396_PEA_1_T19 (SEQ ID NO: 288) | 1565 | 1669 |
| T27396_PEA_1_T20 (SEQ ID NO: 289) | 1565 | 1669 |
| T27396_PEA_1_T23 (SEQ ID NO: 290) | 1565 | 1669 |
| T27396_PEA_1_T29 (SEQ ID NO: 292) | 1565 | 1669 |

Segment cluster T27396_PEA_1_node_36 (SEQ ID NO:320) according to the present invention can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 404 below describes the starting and ending position of this segment on each transcript.

TABLE 404

Segment location on transcripts

| Transcript name | Segment starting position | Segment ending position |
|---|---|---|
| T27396_PEA_1_T2 (SEQ ID NO: 282) | 1658 | 1682 |
| T27396_PEA_1_T3 (SEQ ID NO: 283) | 1721 | 1745 |
| T27396_PEA_1_T9 (SEQ ID NO: 284) | 1670 | 1694 |
| T27396_PEA_1_T11 (SEQ ID NO: 285) | 1670 | 1694 |
| T27396_PEA_1_T12 (SEQ ID NO: 286) | 1670 | 1694 |
| T27396_PEA_1_T13 (SEQ ID NO: 287) | 1670 | 1694 |
| T27396_PEA_1_T19 (SEQ ID NO: 288) | 1670 | 1694 |
| T27396_PEA_1_T20 (SEQ ID NO: 289) | 1670 | 1694 |
| T27396_PEA_1_T23 (SEQ ID NO: 290) | 1670 | 1694 |
| T27396_PEA_1_T29 (SEQ ID NO: 292) | 1670 | 1694 |

Segment cluster T27396_PEA_1_node_38 (SEQ ID NO:321) according to the present invention is supported by 71 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 405 below describes the starting and ending position of this segment on each transcript.

TABLE 405

Segment location on transcripts

| Transcript name | Segment starting position | Segment ending position |
|---|---|---|
| T27396_PEA_1_T2 (SEQ ID NO: 282) | 1683 | 1768 |
| T27396_PEA_1_T3 (SEQ ID NO: 283) | 1746 | 1831 |
| T27396_PEA_1_T9 (SEQ ID NO: 284) | 1695 | 1780 |
| T27396_PEA_1_T11 (SEQ ID NO: 285) | 1695 | 1780 |
| T27396_PEA_1_T12 (SEQ ID NO: 286) | 1695 | 1780 |
| T27396_PEA_1_T13 (SEQ ID NO: 287) | 1695 | 1780 |
| T27396_PEA_1_T19 (SEQ ID NO: 288) | 1695 | 1780 |
| T27396_PEA_1_T20 (SEQ ID NO: 289) | 1695 | 1780 |
| T27396_PEA_1_T23 (SEQ ID NO: 290) | 1695 | 1780 |
| T27396_PEA_1_T29 (SEQ ID NO: 292) | 1695 | 1780 |

Segment cluster T27396_PEA_1_node_40 (SEQ ID NO:322) according to the present invention is supported by 82 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T11(SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290) and T27396_PEA_1_T29 (SEQ ID NO:292). Table 406 below describes the starting and ending position of this segment on each transcript.

TABLE 406

Segment location on transcripts

| Transcript name | Segment starting position | Segment ending position |
|---|---|---|
| T27396_PEA_1_T2 (SEQ ID NO: 282) | 1769 | 1882 |
| T27396_PEA_1_T3 (SEQ ID NO: 283) | 1832 | 1945 |
| T27396_PEA_1_T11 (SEQ ID NO: 285) | 1781 | 1894 |
| T27396_PEA_1_T12 (SEQ ID NO: 286) | 1781 | 1894 |
| T27396_PEA_1_T13 (SEQ ID NO: 287) | 1781 | 1894 |
| T27396_PEA_1_T19 (SEQ ID NO: 288) | 1781 | 1894 |
| T27396_PEA_1_T20 (SEQ ID NO: 289) | 1781 | 1894 |
| T27396_PEA_1_T23 (SEQ ID NO: 290) | 1781 | 1894 |
| T27396_PEA_1_T29 (SEQ ID NO: 292) | 1781 | 1894 |

Segment cluster T27396_PEA_1_node_48 (SEQ ID NO:323) according to the present invention can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289) and T27396_PEA_1_T23 (SEQ ID NO:290). Table 407 below describes the starting and ending position of this segment on each transcript.

TABLE 407

Segment location on transcripts

| Transcript name | Segment starting position | Segment ending position |
|---|---|---|
| T27396_PEA_1_T2 (SEQ ID NO: 282) | 2006 | 2030 |
| T27396_PEA_1_T3 (SEQ ID NO: 283) | 2069 | 2093 |
| T27396_PEA_1_T9 (SEQ ID NO: 284) | 1904 | 1928 |
| T27396_PEA_1_T11 (SEQ ID NO: 285) | 2018 | 2042 |
| T27396_PEA_1_T12 (SEQ ID NO: 286) | 2018 | 2042 |
| T27396_PEA_1_T13 (SEQ ID NO: 287) | 2018 | 2042 |
| T27396_PEA_1_T19 (SEQ ID NO: 288) | 2018 | 2042 |
| T27396_PEA_1_T20 (SEQ ID NO: 289) | 2018 | 2042 |
| T27396_PEA_1_T23 (SEQ ID NO: 290) | 2018 | 2042 |

Segment cluster T27396_PEA_1_node_53 (SEQ ID NO:324) according to the present invention can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T13 (SEQ ID NO:287), T27396_PEA_1_T19 (SEQ ID NO:288), T27396_PEA_1_T20 (SEQ ID NO:289) and T27396_PEA_1_T23 (SEQ ID NO:290). Table 408 below describes the starting and ending position of this segment on each transcript.

TABLE 408

Segment location on transcripts

| Transcript name | Segment starting position | Segment ending position |
|---|---|---|
| T27396_PEA_1_T2 (SEQ ID NO: 282) | 2193 | 2200 |
| T27396_PEA_1_T3 (SEQ ID NO: 283) | 2256 | 2263 |
| T27396_PEA_1_T9 (SEQ ID NO: 284) | 2091 | 2098 |
| T27396_PEA_1_T11 (SEQ ID NO: 285) | 2205 | 2212 |
| T27396_PEA_1_T13 (SEQ ID NO: 287) | 2205 | 2212 |
| T27396_PEA_1_T19 (SEQ ID NO: 288) | 2205 | 2212 |
| T27396_PEA_1_T20 (SEQ ID NO: 289) | 2205 | 2212 |
| T27396_PEA_1_T23 (SEQ ID NO: 290) | 2205 | 2212 |

Segment cluster T27396_PEA_1_node_54 (SEQ ID NO:325) according to the present invention can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289) and T27396_PEA_1_T23 (SEQ ID NO:290). Table 409 below describes the starting and ending position of this segment on each transcript.

TABLE 409

Segment location on transcripts

| Transcript name | Segment starting position | Segment ending position |
|---|---|---|
| T27396_PEA_1_T2 (SEQ ID NO: 282) | 2201 | 2211 |
| T27396_PEA_1_T3 (SEQ ID NO: 283) | 2264 | 2274 |
| T27396_PEA_1_T9 (SEQ ID NO: 284) | 2099 | 2109 |
| T27396_PEA_1_T11 (SEQ ID NO: 285) | 2213 | 2223 |
| T27396_PEA_1_T12 (SEQ ID NO: 286) | 2205 | 2215 |
| T27396_PEA_1_T13 (SEQ ID NO: 287) | 2213 | 2223 |
| T27396_PEA_1_T19 (SEQ ID NO: 288) | 2213 | 2223 |
| T27396_PEA_1_T20 (SEQ ID NO: 289) | 2213 | 2223 |
| T27396_PEA_1_T23 (SEQ ID NO: 290) | 2213 | 2223 |

Segment cluster T27396_PEA_1_node_58 (SEQ ID NO:326) according to the present invention is supported by 106 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T23 (SEQ ID NO:290), T27396_PEA_1_T27 (SEQ ID NO:291) and T27396_PEA_1_T30 (SEQ ID NO:293). Table 410 below describes the starting and ending position of this segment on each transcript.

TABLE 410

Segment location on transcripts

| Transcript name | Segment starting position | Segment ending position |
|---|---|---|
| T27396_PEA_1_T2 (SEQ ID NO: 282) | 2468 | 2494 |
| T27396_PEA_1_T3 (SEQ ID NO: 283) | 2531 | 2557 |
| T27396_PEA_1_T9 (SEQ ID NO: 284) | 2366 | 2392 |
| T27396_PEA_1_T11 (SEQ ID NO: 285) | 2649 | 2675 |
| T27396_PEA_1_T12 (SEQ ID NO: 286) | 2472 | 2498 |
| T27396_PEA_1_T13 (SEQ ID NO: 287) | 2480 | 2506 |
| T27396_PEA_1_T19 (SEQ ID NO: 288) | 2649 | 2675 |
| T27396_PEA_1_T23 (SEQ ID NO: 290) | 2480 | 2506 |
| T27396_PEA_1_T27 (SEQ ID NO: 291) | 605 | 631 |
| T27396_PEA_1_T30 (SEQ ID NO: 293) | 605 | 631 |

Segment cluster T27396_PEA_1_node_59 (SEQ ID NO:327) according to the present invention is supported by 108 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T23 (SEQ ID NO:290), T27396_PEA_1_T27 (SEQ ID NO:291) and T27396_PEA_1_T30 (SEQ ID NO:293). Table 411 below describes the starting and ending position of this segment on each transcript.

TABLE 411

Segment location on transcripts

| Transcript name | Segment starting position | Segment ending position |
|---|---|---|
| T27396_PEA_1_T2 (SEQ ID NO: 282) | 2495 | 2538 |
| T27396_PEA_1_T3 (SEQ ID NO: 283) | 2558 | 2601 |
| T27396_PEA_1_T9 (SEQ ID NO: 284) | 2393 | 2436 |
| T27396_PEA_1_T11 (SEQ ID NO: 285) | 2676 | 2719 |
| T27396_PEA_1_T12 (SEQ ID NO: 286) | 2499 | 2542 |
| T27396_PEA_1_T13 (SEQ ID NO: 287) | 2507 | 2550 |
| T27396_PEA_1_T23 (SEQ ID NO: 290) | 2507 | 2550 |
| T27396_PEA_1_T27 (SEQ ID NO: 291) | 632 | 675 |
| T27396_PEA_1_T30 (SEQ ID NO: 293) | 632 | 675 |

Segment cluster T27396_PEA_1_node_60 (SEQ ID NO:328) according to the present invention is supported by 107 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T23 (SEQ ID NO:290), T27396_PEA_1_T27 (SEQ ID NO:291) and T27396_PEA_1_T30 (SEQ ID NO:293). Table 412 below describes the starting and ending position of this segment on each transcript.

TABLE 412

Segment location on transcripts

| Transcript name | Segment starting position | Segment ending position |
|---|---|---|
| T27396_PEA_1_T2 (SEQ ID NO: 282) | 2539 | 2564 |
| T27396_PEA_1_T3 (SEQ ID NO: 283) | 2602 | 2627 |
| T27396_PEA_1_T9 (SEQ ID NO: 284) | 2437 | 2462 |
| T27396_PEA_1_T11 (SEQ ID NO: 285) | 2720 | 2745 |
| T27396_PEA_1_T12 (SEQ ID NO: 286) | 2543 | 2568 |
| T27396_PEA_1_T13 (SEQ ID NO: 287) | 2551 | 2576 |
| T27396_PEA_1_T23 (SEQ ID NO: 290) | 2551 | 2576 |
| T27396_PEA_1_T27 (SEQ ID NO: 291) | 676 | 701 |
| T27396_PEA_1_T30 (SEQ ID NO: 293) | 676 | 701 |

Segment cluster T27396_PEA_1_node_61 (SEQ ID NO:329) according to the present invention can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T23 (SEQ ID NO:290), T27396_PEA_1_T27 (SEQ ID NO:291) and T27396_PEA_1_T30 (SEQ ID NO:293). Table 413 below describes the starting and ending position of this segment on each transcript.

TABLE 413

Segment location on transcripts

| Transcript name | Segment starting position | Segment ending position |
|---|---|---|
| T27396_PEA_1_T2 (SEQ ID NO: 282) | 2565 | 2568 |
| T27396_PEA_1_T3 (SEQ ID NO: 283) | 2628 | 2631 |
| T27396_PEA_1_T9 (SEQ ID NO: 284) | 2463 | 2466 |
| T27396_PEA_1_T11 (SEQ ID NO: 285) | 2746 | 2749 |
| T27396_PEA_1_T12 (SEQ ID NO: 286) | 2569 | 2572 |
| T27396_PEA_1_T23 (SEQ ID NO: 290) | 2577 | 2580 |
| T27396_PEA_1_T27 (SEQ ID NO: 291) | 702 | 705 |
| T27396_PEA_1_T30 (SEQ ID NO: 293) | 702 | 705 |

Segment cluster T27396_PEA_1_node_62 (SEQ ID NO:330) according to the present invention can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T27 (SEQ ID NO:291) and T27396_PEA_1_T30 (SEQ ID NO:293). Table 414 below describes the starting and ending position of this segment on each transcript.

TABLE 414

Segment location on transcripts

| Transcript name | Segment starting position | Segment ending position |
|---|---|---|
| T27396_PEA 1_T2 (SEQ ID NO: 282) | 2569 | 2582 |
| T27396_PEA_1_T3 (SEQ ID NO: 283) | 2632 | 2645 |
| T27396_PEA_1_T9 (SEQ ID NO: 284) | 2467 | 2480 |
| T27396_PEA_1_T11 (SEQ ID NO: 285) | 2750 | 2763 |
| T27396_PEA_1_T12 (SEQ ID NO: 286) | 2573 | 2586 |
| T27396_PEA_1_T27 (SEQ ID NO: 291) | 706 | 719 |
| T27396_PEA_1_T30 (SEQ ID NO: 293) | 706 | 719 |

Segment cluster T27396_PEA_1_node_63 (SEQ ID NO:331) according to the present invention can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T27 (SEQ ID NO:291) and T27396_PEA_1_T30 (SEQ ID NO:293). Table 415 below describes the starting and ending position of this segment on each transcript.

TABLE 415

Segment location on transcripts

| Transcript name | Segment starting position | Segment ending position |
|---|---|---|
| T27396_PEA_1_T2 (SEQ ID NO: 282) | 2583 | 2604 |
| T27396_PEA_1_T3 (SEQ ID NO: 283) | 2646 | 2667 |
| T27396_PEA_1_T9 (SEQ ID NO: 284) | 2481 | 2502 |
| T27396_PEA_1_T11 (SEQ ID NO: 285) | 2764 | 2785 |
| T27396_PEA_1_T12 (SEQ ID NO: 286) | 2587 | 2608 |
| T27396_PEA_1_T27 (SEQ ID NO: 291) | 720 | 741 |
| T27396_PEA_1_T30 (SEQ ID NO: 293) | 720 | 741 |

Segment cluster T27396_PEA_1_node_64 (SEQ ID NO:332) according to the present invention is supported by 12 libraries. The number of libraries was determined as previously described. This segment can be found in the following transcript(s): T27396_PEA_1_T30 (SEQ ID NO:293). Table 416 below describes the starting and ending position of this segment on each transcript.

TABLE 416

Segment location on transcripts

| Transcript name | Segment starting position | Segment ending position |
|---|---|---|
| T27396_PEA_1_T30 (SEQ ID NO: 293) | 742 | 824 |

Segment cluster T27396_PEA_1_node_65 (SEQ ID NO:333) according to the present invention is supported by 117 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T27 (SEQ ID NO:291) and T27396_PEA_1_T30 (SEQ ID NO:293). Table 417 below describes the starting and ending position of this segment on each transcript.

TABLE 417

Segment location on transcripts

| Transcript name | Segment starting position | Segment ending position |
|---|---|---|
| T27396_PEA_1_T2 (SEQ ID NO: 282) | 2605 | 2662 |
| T27396_PEA_1_T3 (SEQ ID NO: 283) | 2668 | 2725 |
| T27396_PEA_1_T9 (SEQ ID NO: 284) | 2503 | 2560 |
| T27396_PEA_1_T11 (SEQ ID NO: 285) | 2786 | 2843 |
| T27396_PEA_1_T12 (SEQ ID NO: 286) | 2609 | 2666 |
| T27396_PEA_1_T13 (SEQ ID NO: 287) | 2577 | 2634 |
| T27396_PEA_1_T19 (SEQ ID NO: 288) | 2676 | 2733 |
| T27396_PEA_1_T20 (SEQ ID NO: 289) | 2480 | 2537 |
| T27396_PEA_1_T27 (SEQ ID NO: 291) | 742 | 799 |
| T27396_PEA_1_T30 (SEQ ID NO: 293) | 825 | 882 |

Segment cluster T27396_PEA_1_node_66 (SEQ ID NO:334) according to the present invention is supported by 135 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T27 (SEQ ID NO:291) and T27396_PEA_1_T30 (SEQ ID NO:293). Table 418 below describes the starting and ending position of this segment on each transcript.

TABLE 418

Segment location on transcripts

| Transcript name | Segment starting position | Segment ending position |
|---|---|---|
| T27396_PEA_1_T2 (SEQ ID NO: 282) | 2663 | 2726 |
| T27396_PEA_1_T3 (SEQ ID NO: 283) | 2726 | 2789 |
| T27396_PEA_1_T9 (SEQ ID NO: 284) | 2561 | 2624 |
| T27396_PEA_1_T11 (SEQ ID NO: 285) | 2844 | 2907 |
| T27396_PEA_1_T12 (SEQ ID NO: 286) | 2667 | 2730 |
| T27396_PEA_1_T13 (SEQ ID NO: 287) | 2635 | 2698 |
| T27396_PEA_1_T19 (SEQ ID NO: 288) | 2734 | 2797 |
| T27396_PEA_1_T20 (SEQ ID NO: 289) | 2538 | 2601 |
| T27396_PEA_1_T27 (SEQ ID NO: 291) | 800 | 863 |
| T27396_PEA_1_T30 (SEQ ID NO: 293) | 883 | 946 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 419.

TABLE 419

Oligonucleotides related to this segment

| Oligonucleotide name | Overexpressed in cancers | Chip reference |
|---|---|---|
| T27396_0_10_0 (SEQ ID NO: 516) | ovarian carcinoma | OVA |

The sequence for oligonucleotide T27396_0_10_0_ (SEQ ID NO:516) is given above.

Segment cluster T27396_PEA_1_node_68 (SEQ ID NO:335) according to the present invention is supported by 137 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T27 (SEQ ID NO:291) and T27396_PEA_1_T30 (SEQ ID NO:293). Table 420 below describes the starting and ending position of this segment on each transcript.

TABLE 420

Segment location on transcripts

| Transcript name | Segment starting position | Segment ending position |
|---|---|---|
| T27396_PEA_1_T2 (SEQ ID NO: 282) | 3104 | 3143 |
| T27396_PEA_1_T3 (SEQ ID NO: 283) | 3167 | 3206 |
| T27396_PEA_1_T9 (SEQ ID NO: 284) | 3002 | 3041 |
| T27396_PEA_1_T11 (SEQ ID NO: 285) | 3285 | 3324 |
| T27396_PEA_1_T12 (SEQ ID NO: 286) | 3108 | 3147 |
| T27396_PEA_1_T13 (SEQ ID NO: 287) | 3076 | 3115 |
| T27396_PEA_1_T19 (SEQ ID NO: 288) | 3175 | 3214 |
| T27396_PEA_1_T20 (SEQ ID NO: 289) | 2979 | 3018 |
| T27396_PEA_1_T27 (SEQ ID NO: 291) | 1241 | 1280 |
| T27396_PEA_1_T30 (SEQ ID NO: 293) | 1324 | 1363 |

Segment cluster T27396_PEA_1_node_69 (SEQ ID NO:336) according to the present invention is supported by 135 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T9 (SEQ ID NO:288), T27396_PEA_1_T20 (SEQ ID NO:289), T27396_PEA_1_T27 (SEQ ID NO:291) and T27396_PEA_1_T30 (SEQ ID NO:293). Table 421 below describes the starting and ending position of this segment on each transcript.

TABLE 421

Segment location on transcripts

| Transcript name | Segment starting position | Segment ending position |
|---|---|---|
| T27396_PEA_1_T2 (SEQ ID NO: 282) | 3144 | 3249 |
| T27396_PEA_1_T3 (SEQ ID NO: 283) | 3207 | 3312 |
| T27396_PEA_1_T9 (SEQ ID NO: 284) | 3042 | 3147 |
| T27396_PEA_1_T11 (SEQ ID NO: 285) | 3325 | 3430 |
| T27396_PEA_1_T12 (SEQ ID NO: 286) | 3148 | 3253 |
| T27396_PEA_1_T13 (SEQ ID NO: 287) | 3116 | 3221 |
| T27396_PEA_1_T19 (SEQ ID NO: 288) | 3215 | 3320 |
| T27396_PEA_1_T20 (SEQ ID NO: 289) | 3019 | 3124 |
| T27396_PEA_1_T27 (SEQ ID NO: 291) | 1281 | 1386 |
| T27396_PEA_1_T30 (SEQ ID NO: 293) | 1364 | 1469 |

Segment cluster T27396_PEA_1_node_70 (SEQ ID NO:337) according to the present invention is supported by 110 libraries. The number of libraries was determined as previously described. This segment can be found in the following transcript(s): T27396_PEA_1_T2 (SEQ ID NO:282), T27396_PEA_1_T3 (SEQ ID NO:283), T27396_PEA_1_T9 (SEQ ID NO:284), T27396_PEA_1_T11 (SEQ ID NO:285), T27396_PEA_1_T12 (SEQ ID NO:286), T27396_PEA_1_T13 (SEQ ID NO:287), T27396_PEA_1_T19 (SEQ ID NO:288), T27396_PEA_1_T20 (SEQ ID NO:289), T27396_PEA_1_T23 (SEQ ID NO:290), T27396_PEA_1_T27 (SEQ ID NO:291) and T27396_PEA_1_T30 (SEQ ID NO:293). Table 422 below describes the starting and ending position of this segment on each transcript.

TABLE 422

Segment location on transcripts

| Transcript name | Segment starting position | Segment ending position |
|---|---|---|
| T27396_PEA_1_T2 (SEQ ID NO: 282) | 3250 | 3305 |
| T27396_PEA_1_T3 (SEQ ID NO: 283) | 3313 | 3368 |
| T27396_PEA_1_T9 (SEQ ID NO: 284) | 3148 | 3203 |
| T27396_PEA_1_T11 (SEQ ID NO: 285) | 3431 | 3486 |
| T27396_PEA_1_T12 (SEQ ID NO: 286) | 3254 | 3309 |
| T27396_PEA_1_T13 (SEQ ID NO: 287) | 3222 | 3277 |
| T27396_PEA_1_T19 (SEQ ID NO: 288) | 3321 | 3376 |
| T27396_PEA_1_T20 (SEQ ID NO: 289) | 3125 | 3180 |
| T27396_PEA_1_T23 (SEQ ID NO: 290) | 2581 | 2636 |
| T27396_PEA_1_T27 (SEQ ID NO: 291) | 1387 | 1442 |
| T27396_PEA_1_T30 (SEQ ID NO: 293) | 1470 | 1525 |

The alignment of T27396 variant proteins to the previously known proteins is shown in the attached CD-Rom Expression of *Homo sapiens* Suppression of Tumorigenicity 14 T27396 Transcripts which are Detectable by Amplicon as Depicted in Sequence Name T27396 jun43-45 (SEQ ID NO:502) in Normal and Cancerous Ovary Tissues:

Expression of *Homo sapiens* suppression of tumorigenicity 14 transcripts detectable by or according to junc43-45, T27396 jun43-45 (SEQ ID NO:502) amplicon and primers T27396 jun43-45F (SEQ ID NO:500) and T27396 jun43-45R (SEQ ID NO:501) was measured by real time PCR. In parallel the expression of four housekeeping genes—PBGD (GenBank Accession No. BC019323 (SEQ ID NO:430); amplicon—PBGD—amplicon (SEQ ID NO:433)), HPRT1 (GenBank Accession No. NM_000194 (SEQ ID NO:434); amplicon—HPRT1—amplicon (SEQ ID NO:437)), SDHA (GenBank Accession No. NM_004168 (SEQ ID NO:462); amplicon—SDHA—amplicon (SEQ ID NO:465)) and GAPDH (GenBank Accession No. BC026907 (SEQ ID NO:438); GAPDH amplicon (SEQ ID NO:441) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45, 46, 48, 71, Table 2_2, above), to obtain a value of fold up-regulation for each sample relative to median of the normal PM samples.

Figure 37:
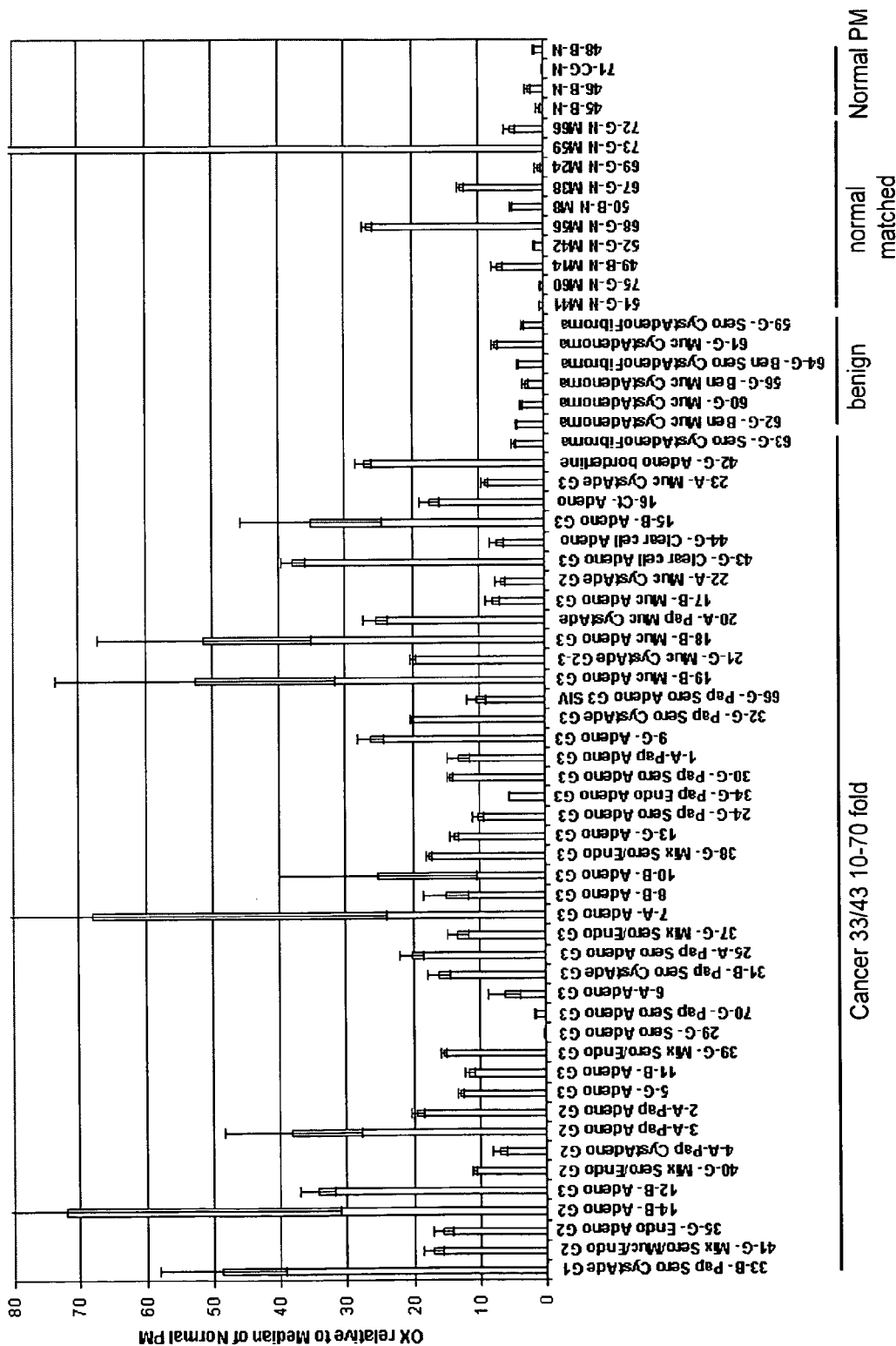
FIG. 37 is a histogram showing over expression of the *Homo sapiens* suppression of tumorigenicity 14 T27396 transcripts which are detectable by amplicon as depicted in sequence name T27396 jun43-45 (SEQ ID NO:502) in cancerous ovary samples relative to the normal samples.

FIG. 37 is a histogram showing over expression of the above-indicated *Homo sapiens* suppression of tumorigenicity 14 transcripts in cancerous ovary samples relative to the normal samples. Values represent the average of duplicate experiments. Error bars indicate the minimal and maximal values obtained.

As is evident from FIG. 37, the expression of *Homo sapiens* suppression of tumorigenicity 14 transcripts detectable by the above amplicon in cancer samples was significantly higher than in the non-cancerous samples (Sample Nos. 45, 46, 48, 71, Table 2_2). Notably an over-expression of at least 10 fold was found in 33 out of 43 adenocarcinoma samples.

Statistical analysis was applied to verify the significance of these results, as described below.

The P value for the difference in the expression levels of *Homo sapiens* suppression of tumorigenicity 14 transcripts detectable by the above amplicon in ovary cancer samples versus the normal tissue samples was determined by T test as 7.19E-10.

Threshold of 10 fold overexpression was found to differentiate between cancer and normal samples with P value of 5.61E-03 as checked by exact fisher test. The above values demonstrate statistical significance of the results. Primer pairs are also optionally and preferably encompassed within the present invention; for example, for the above experiment, the following primer pair was used as a non-limiting illustrative example only of a suitable primer pair: T27396 jun43-45F (SEQ ID NO:500) forward primer; and T27396jun43-45R (SEQ ID NO:501) reverse primer.

The present invention also preferably encompasses any amplicon obtained through the use of any suitable primer pair; for example, for the above experiment, the following amplicon was obtained as a non-limiting illustrative example only of a suitable amplicon: T27396 jun43-45 (SEQ ID NO:502).

Expression of *Homo sapiens* Suppression of Tumorigenicity 14 (Colon Carcinoma, Matriptase, Epithin) T27396 Transcripts which are Detectable by Amplicon as Depicted in Sequence Name T27396 junc43-45 (SEQ ID NO:502) in Normal and Cancerous Breast Tissues:

Expression of *Homo sapiens* suppression of tumorigenicity 14 (colon carcinoma, matriptase, epithin) transcripts detectable by or according to junc43-45, T27396 junc43-45 (SEQ ID NO:502) amplicon(s) and primers T27396 junc43-45F (SEQ ID NO:500) and T27396 junc43-45R (SEQ ID NO:501) was measured by real time PCR. In parallel the expression of four housekeeping genes—PBGD (GenBank Accession No. BC019323 (SEQ ID NO:430); amplicon—PBGD—amplicon (SEQ ID NO:433)), HPRT1 (GenBank Accession No. NM_000194 (SEQ ID NO:434); amplicon—HPRT1—amplicon (SEQ ID NO:437)), SDHA (GenBank Accession No. NM_004168 (SEQ ID NO:462); amplicon—SDHA—amplicon (SEQ ID NO:465)) and G6PD (GenBank Accession No. NM_000402 (SEQ ID NO:442); G6PD amplicon (SEQ ID NO:445)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 2_5, above "Tissue samples in breast cancer testing panel"), to obtain a value of fold up-regulation for each sample relative to median of the normal PM samples.

Figure 38:
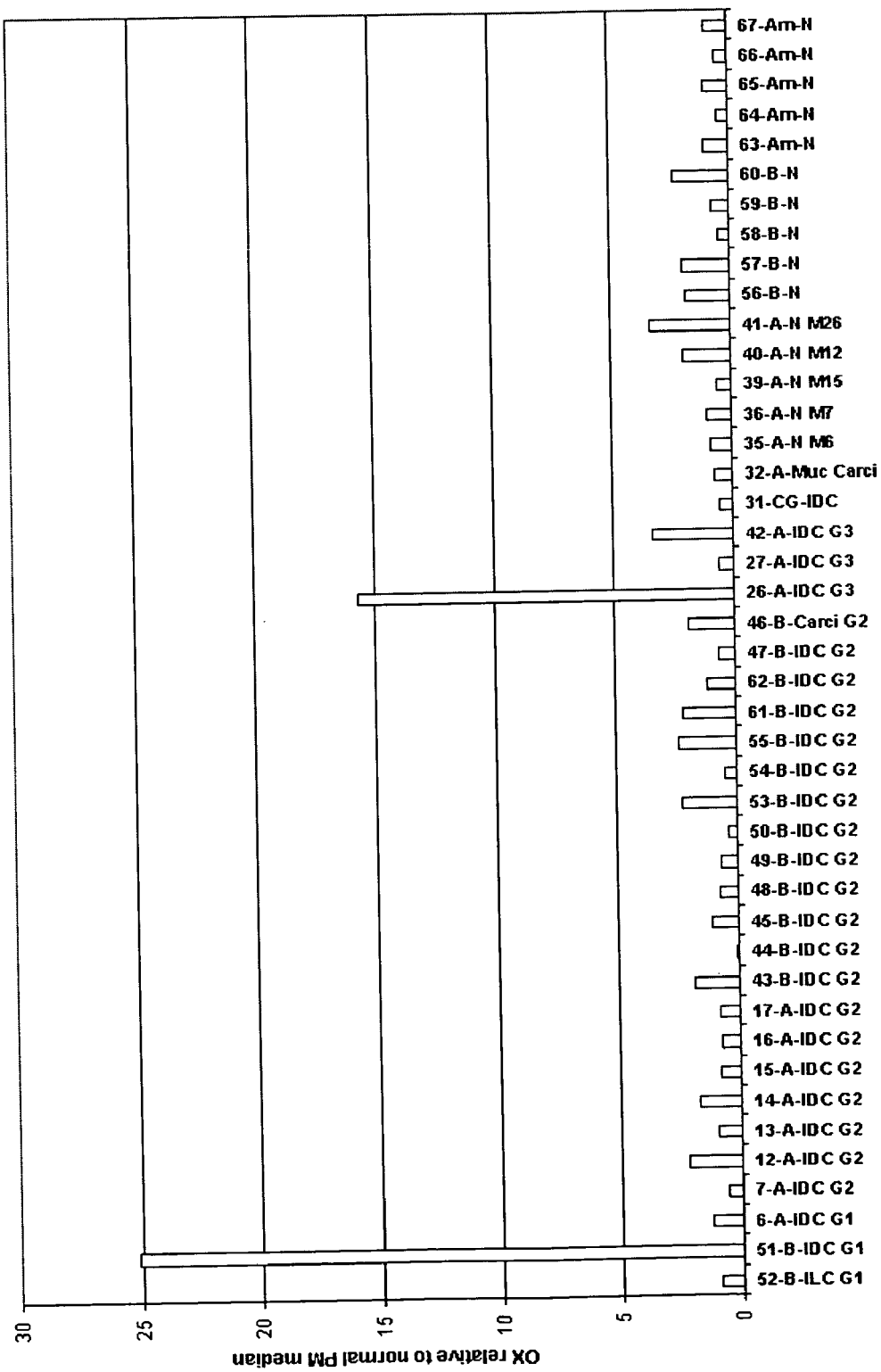
FIG. 38 is a histogram showing over expression of the above-indicated *Homo sapiens* suppression of tumorigenicity 14 T27396 transcripts which are detectable by amplicon as depicted in sequence name T27396 jun43-45 (SEQ ID NO:502) in cancerous breast samples relative to the normal samples.

FIG. 38 is a histogram showing over expression of the above-indicated *Homo sapiens* suppression of tumorigenicity 14 (colon carcinoma, matriptase, epithin) transcripts in cancerous breast samples relative to the normal samples.

As is evident from FIG. 38, the expression of *Homo sapiens* suppression of tumorigenicity 14 (colon carcinoma, matriptase, epithin) transcripts detectable by the above amplicon(s) was higher in a few cancer samples than in the non-cancerous samples (Sample Nos. 56-60, 63-67 Table 2_5, "Tissue samples in breast cancer testing panel"). Notably an over-expression of at least 5 fold was found in 2 out of 28 adenocarcinoma samples.

Primer pairs are also optionally and preferably encompassed within the present invention; for example, for the above experiment, the following primer pair was used as a non-limiting illustrative example only of a suitable primer pair: T27396 junc43-45F (SEQ ID NO:500) forward primer; and T27396 junc43-45R (SEQ ID NO:501) reverse primer.

The present invention also preferably encompasses any amplicon obtained through the use of any suitable primer pair; for example, for the above experiment, the following amplicon was obtained as a non-limiting illustrative example only of a suitable amplicon: T27396 junc43-45 (SEQ ID NO:502).

```
Primers:
Forward primer T27396 jun43-45F (SEQ ID NO: 500):
CGCTGCCTCAATGGGC

Reverse primer T27396 jun43-45R (SEQ ID NO: 501):
AGGCCACAGCTCGCAGTC

Amplicon T27396 jun43-45 (SEQ ID NO: 502):
CGCTGCCTCAATGGGCTCTGCTTGAGCAAGGGCAACCCTGAGTGTGACGGGAAGGAG

GACTGTAGCGACGGCTCAGATGAGAAGGACTGCGAGCTGTGGCCT
```

```
Primers:
Forward primer T27396 jun43-45F (SEQ ID NO: 500):
CGCTGCCTCAATGGGC

Reverse primer T27396 jun43-45R (SEQ ID NO: 501):
AGGCCACAGCTCGCAGTC

Amplicon T27396 jun43-45 (SEQ ID NO: 502):
CGCTGCCTCAATGGGCTCTGCTTGAGCAAGGGCAACCCTGAGTGTGACGGGAAGGAG

GACTGTAGCGACGGCTCAGATGAGAAGGACTGCGAGCTGTGGCCT
```

Expression of *Homo sapiens* Suppression of Tumorigenicity 14 T27396 Transcripts which are Detectable by Amplicon as Depicted in Sequence Name T27396 junc60-65 (SEQ ID NO:505) in Normal and Cancerous Breast Tissues:

Expression of *Homo sapiens* suppression of tumorigenicity 14 transcripts detectable by or according to junc60-65, T27396 junc60-65 (SEQ ID NO:505) amplicon(s) and primers T27396 junc60-65F (SEQ ID NO:503) and T27396 junc60-65R (SEQ ID NO:504) was measured by real time PCR. In parallel the expression of four housekeeping genes—PBGD (GenBank Accession No. BC019323 (SEQ ID NO:430); amplicon—PBGD—amplicon (SEQ ID NO:433)), HPRT1 (GenBank Accession No. NM_000194 (SEQ ID NO:434); amplicon—HPRT1—amplicon (SEQ ID NO:437)), SDHA (GenBank Accession No. NM_004168 (SEQ ID NO:462); amplicon—SDHA—amplicon (SEQ ID NO:465)) and G6PD (GenBank Accession No. NM_000402 (SEQ ID NO:442); G6PD amplicon (SEQ ID NO:445)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 56-60, 63-67, Table 2_5, above "Tissue samples in breast cancer testing panel"), to obtain a value of fold up-regulation for each sample relative to median of the normal PM samples.

Figure 39:
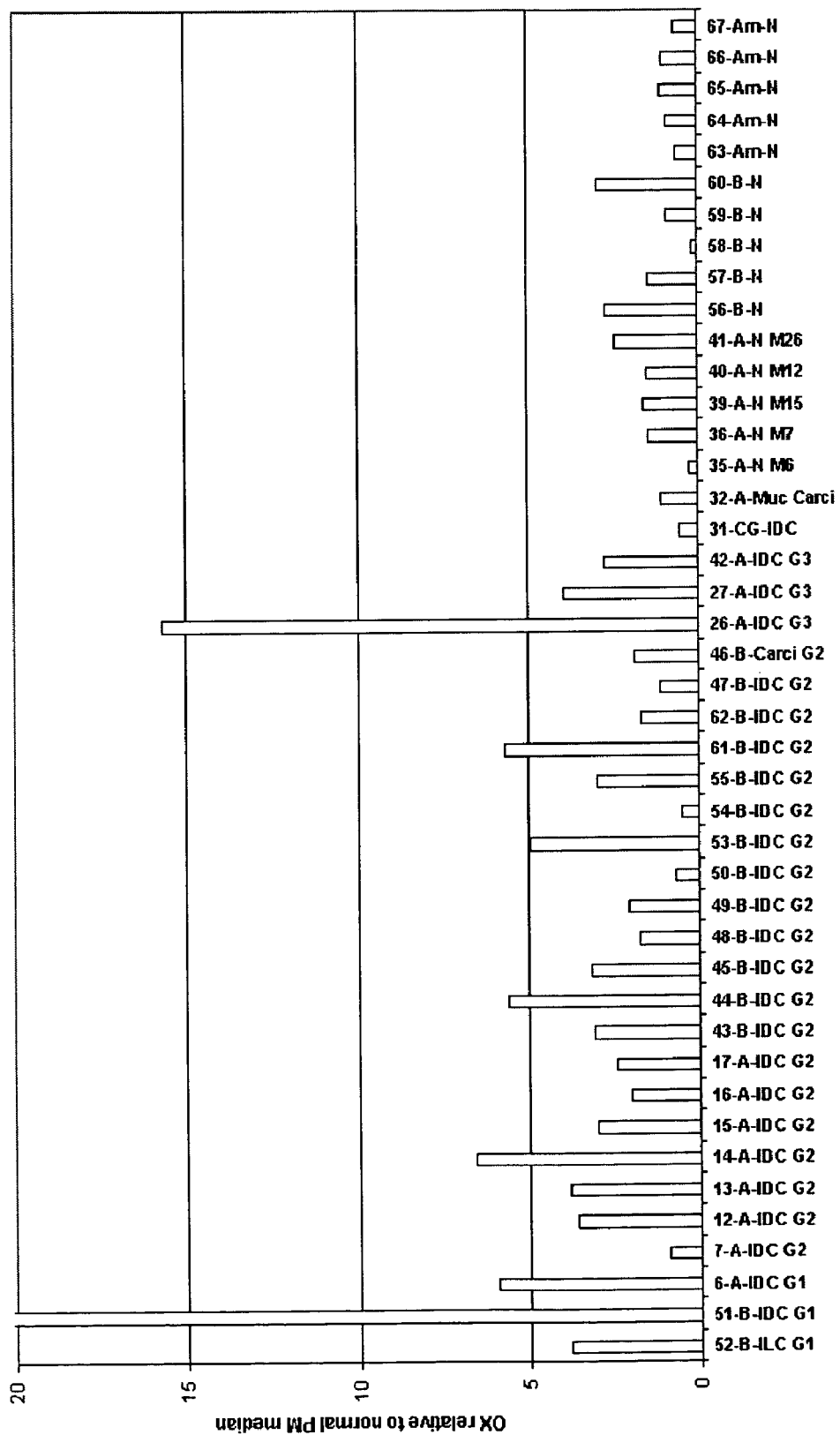
FIG. 39 is a histogram showing over expression of the above-indicated *Homo sapiens* suppression of tumorigenicity 14 T27396 transcripts which are detectable by amplicon as depicted in sequence name T27396 jun60-65 (SEQ ID NO:505) in cancerous breast samples relative to the normal samples.

FIG. 39 is a histogram showing over expression of the above-indicated *Homo sapiens* suppression of tumorigenicity 14 transcripts in cancerous breast samples relative to the normal samples.

As is evident from FIG. 39, the expression of *Homo sapiens* suppression of tumorigenicity 14 transcripts detectable by the above amplicon(s) was higher in a few cancer samples than in the non-cancerous samples (Sample Nos. 56-60, 63-67 Table 2_5, "Tissue samples in breast cancer testing panel"). Notably an over-expression of at least 5 fold was found in 7 out of 28 adenocarcinoma samples.

Primer pairs are also optionally and preferably encompassed within the present invention; for example, for the above experiment, the following primer pair was used as a non-limiting illustrative example only of a suitable primer pair: T27396 junc60-65F (SEQ ID NO:503) forward primer; and T27396 junc60-65R (SEQ ID NO:504) reverse primer.

The present invention also preferably encompasses any amplicon obtained through the use of any suitable primer pair; for example, for the above experiment, the following amplicon was obtained as a non-limiting illustrative example only of a suitable amplicon: T27396 junc60-65 (SEQ ID NO:505).

```
Primers:
Forward primer T27396 junc60-65F (SEQ ID NO: 503):
CCGCGCATGATGGTGA Reverse primer T27396 junc60-65R (SEQ ID NO: 504):
GGAGCCTTGTGTACACGCCT Amplicon T27396 junc60-65 (SEQ ID NO: 505):
CCGCGCATGATGGTGATTCCGGGGGACCCCTGTCCAGCGTGGAGGCGGATGGGCGGA

TCTTCCAGGCCGGTGTGGTGAGCTGGGGAGACGGCTGCGCTCAGAGGAACAAGCCAG

GCGTGTACACAAGGCTCC
```

Expression of *Homo sapiens* Suppression of Tumorigenicity 14 T27396 Transcripts which are Detectable by Amplicon as Depicted in Sequence Name T27396 jun60-65 (SEQ ID NO:505) in Normal and Cancerous Ovary Tissues:

Expression of *Homo sapiens* suppression of tumorigenicity 14 transcripts detectable by or according to junc60-65, T27396 jun60-65 (SEQ ID NO:505) amplicon and primers T27396 jun60-65F (SEQ ID NO:503) and T27396 jun60-65R (SEQ ID NO:504) was measured by real time PCR. In parallel the expression of four housekeeping genes—PBGD (GenBank Accession No. BC019323 (SEQ ID NO:430); amplicon—PBGD—amplicon (SEQ ID NO:433)), HPRT1 (GenBank Accession No. NM_000194 (SEQ ID NO:434); amplicon—HPRT1—amplicon (SEQ ID NO:437)), SDHA (GenBank Accession No. NM_004168 (SEQ ID NO:462); amplicon—SDHA—amplicon (SEQ ID NO:465)) and GAPDH (GenBank Accession No. BC026907 (SEQ ID NO:438); GAPDH amplicon (SEQ ID NO:441) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 45, 46, 48, 71, Table 2_2, above), to obtain a value of fold up-regulation for each sample relative to median of the normal PM samples.

Figure 40:
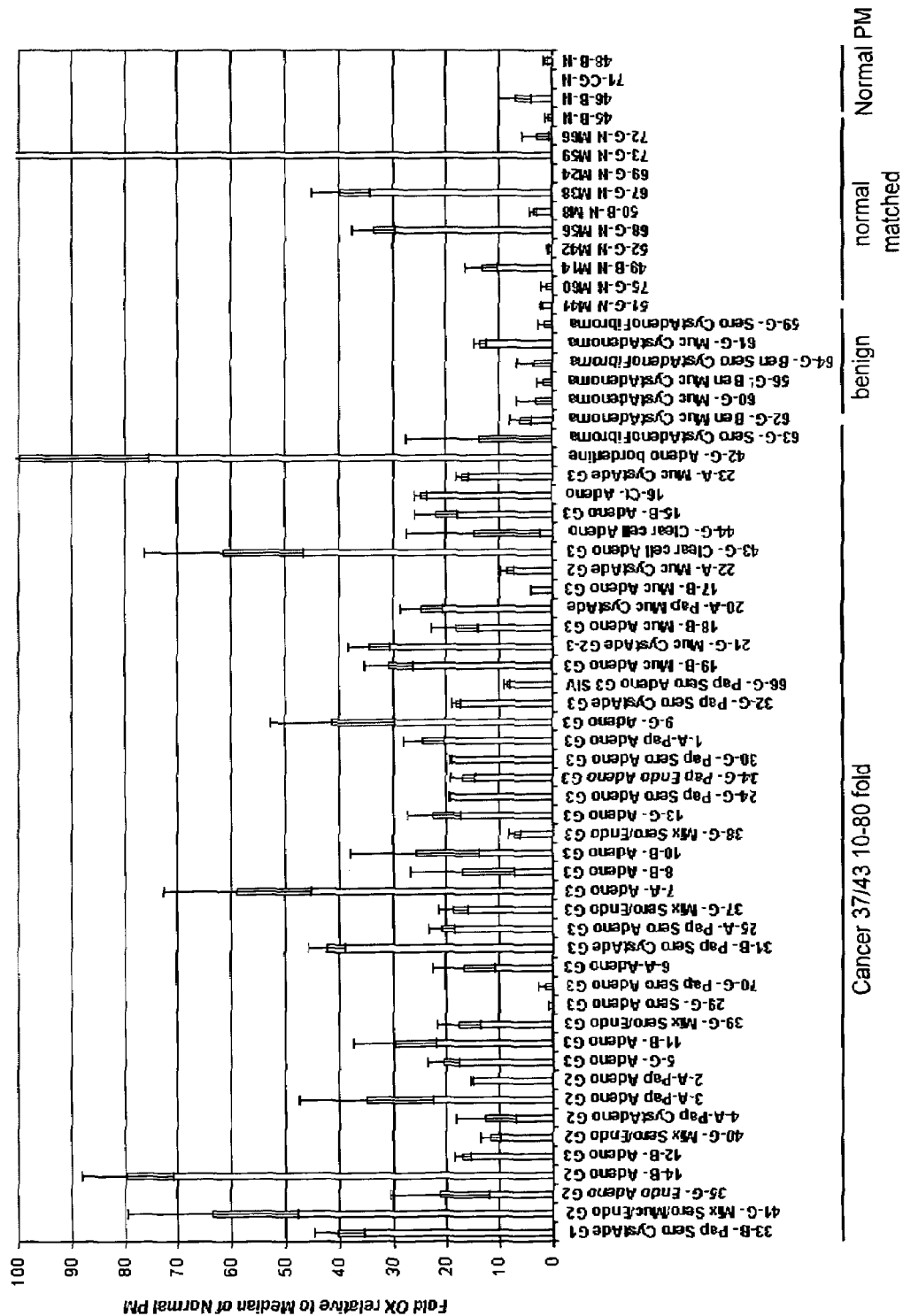
FIG. 40 is a histogram showing over expression of the *Homo sapiens* suppression of tumorigenicity 14 T27396 transcripts which are detectable by amplicon as depicted in sequence name T27396 jun60-65 (SEQ ID NO:505) in cancerous ovary samples relative to the normal samples.

FIG. 40 is a histogram showing over expression of the above-indicated *Homo sapiens* suppression of tumorigenicity 14 transcripts in cancerous ovary samples relative to the normal samples. Values represent the average of duplicate experiments. Error bars indicate the minimal and maximal values obtained.

As is evident from FIG. 40, the expression of *Homo sapiens* suppression of tumorigenicity 14 transcripts detectable by the above amplicon in cancer samples was significantly higher than in the non-cancerous samples (Sample Nos. 45, 46, 48, 71, Table 2_2). Notably an over-expression of at least 10 fold was found in 37 out of 43 adenocarcinoma samples.

Statistical analysis was applied to verify the significance of these results, as described below.

The P value for the difference in the expression levels of *Homo sapiens* suppression of tumorigenicity 14 transcripts detectable by the above amplicon in ovary cancer samples versus the normal tissue samples was determined by T test as 4.37E-08.

Threshold of 10 fold overexpression was found to differentiate between cancer and normal samples with P value of 1.18E-03 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: T27396 jun60-65F (SEQ ID NO:503) forward primer; and T27396 jun60-65R (SEQ ID NO:504) reverse primer.

The present invention also preferably encompasses any amplicon obtained through the use of any suitable primer pair; for example, for the above experiment, the following amplicon was obtained as a non-limiting illustrative example only of a suitable amplicon: T27396 jun60-65 (SEQ ID NO:505).

Expression of *Homo sapiens* Suppression of Tumorigenicity 14 (Colon Carcinoma, Matriptase, Epithin) T27396 Transcripts which are Detectable by Amplicon as Depicted in Sequence Name T27396 junc43-45 (SEQ ID NO:502) in Normal and Cancerous Colon Tissues:

Expression of *Homo sapiens* suppression of tumorigenicity 14 (colon carcinoma, matriptase, epithin)] transcripts detectable by or according to junc43-45, T27396 junc60-65 (SEQ ID NO:505) amplicon(s) and primers T27396 junc43-45F (SEQ ID NO:500) and T27396 junc43-45R (SEQ ID NO:501) was measured by real time PCR. In parallel the expression of four housekeeping genes -PBGD (GenBank Accession No. BC019323 (SEQ ID NO:430); amplicon—PBGD—amplicon (SEQ ID NO:433)), HPRT1 (GenBank Accession No. NM_000194 (SEQ ID NO:434); amplicon—HPRT1—amplicon (SEQ ID NO:437)), G6PD (GenBank Accession No. NM_000402 (SEQ ID NO:442); G6PD amplicon (SEQ ID NO:445)), RPS27A (GenBank Accession No. NM_002954 (SEQ ID NO:446); RPS27A amplicon (SEQ ID NO:446)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 42, 48-53, 59-63, Table 2_3, above "Tissue samples in colon cancer testing panel"), to obtain a value of fold differential expression for each sample relative to median of the normal PM samples.

In one experiment that was carried out no differential expression in the cancerous samples relative to the normal PM samples was observed.

Primer pairs are also optionally and preferably encompassed within the present invention; for example, for the above experiment, the following primer pair was used as a non-limiting illustrative example only of a suitable primer pair: T27396 junc43-45F (SEQ ID NO:500) forward primer; and T27396 junc43-45R (SEQ ID NO:501) reverse primer.

The present invention also preferably encompasses any amplicon obtained through the use of any suitable primer pair; for example, for the above experiment, the following amplicon was obtained as a non-limiting illustrative example only of a suitable amplicon: T27396 junc43-45 (SEQ ID NO:502).

```
Primers:
Forward primer T27396 junc60-65F (SEQ ID NO: 503):
CCGCGCATGATGGTGA Reverse primer T27396 junc60-65R (SEQ ID NO: 504):
GGAGCCTTGTGTACACGCCT Amplicon T27396 junc60-65 (SEQ ID NO: 505):
CCGCGCATGATGGTGATTCCGGGGGACCCCTGTCCAGCGTGGAGGCGGATGGGCGGA

TCTTCCAGGCCGGTGTGGTGAGCTGGGGAGACGGCTGCGCTCAGAGGAACAAGCCAG

GCGTGTACACAAGGCTCC
```

```
Primers:
Forward primer T27396 jun43-45F (SEQ ID NO: 500):
CGCTGCCTCAATGGGC

Reverse primer T27396 jun43-45R (SEQ ID NO: 501):
AGGCCACAGCTCGCAGTC

Amplicon T27396 jun43-45 (SEQ ID NO: 502):
CGCTGCCTCAATGGGCTCTGCTTGAGCAAGGGCAACCCTGAGTGTGACGGGAAGGAG

GACTGTAGCGACGGCTCAGATGAGAAGGACTGCGAGCTGTGGCCT
```

Expression of *Homo sapiens* Suppression of Tumorigenicity 14 (Colon Carcinoma, Matriptase, Epithin) T27396 Transcripts which are Detectable by Amplicon as Depicted in Sequence Name T27396 junc43-45 (SEQ ID NO:502) in Normal and Cancerous Lung Tissues:

Expression of *Homo sapiens* suppression of tumorigenicity 14 (colon carcinoma, matriptase, epithin) transcripts detectable by or according to junc43-45, T27396 junc43-45 (SEQ ID NO:502) amplicon(s) and primers T27396 junc43-45F (SEQ ID NO:500) and T27396 junc43-45R (SEQ ID NO:501) was measured by real time PCR. In parallel the expression of four housekeeping genes—PBGD (GenBank Accession No. BC019323 (SEQ ID NO:430); amplicon—PBGD—amplicon (SEQ ID NO:433)), HPRT1 (GenBank Accession No. NM_000194 (SEQ ID NO:434); amplicon—HPRT1—amplicon (SEQ ID NO:437)), Ubiquitin (GenBank Accession No. BC000449 (SEQ ID NO:458); amplicon—Ubiquitin—amplicon (SEQ ID NO:461)) and SDHA (GenBank Accession No. NM_004168 (SEQ ID NO:462); amplicon—SDHA—amplicon (SEQ ID NO:465)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2_4, above "Tissue samples in lung cancer testing panel"), to obtain a value of fold differential expression for each sample relative to median of the normal PM samples.

In one experiment that was carried out no differential expression in the cancerous samples relative to the normal PM samples was observed.

Primer pairs are also optionally and preferably encompassed within the present invention; for example, for the above experiment, the following primer pair was used as a non-limiting illustrative example only of a suitable primer pair: T27396 junc43-45F (SEQ ID NO:500) forward primer; and T27396junc43-45R (SEQ ID NO:501) reverse primer.

The present invention also preferably encompasses any amplicon obtained through the use of any suitable primer pair; for example, for the above experiment, the following amplicon was obtained as a non-limiting illustrative example only of a suitable amplicon: T27396 junc43-45 (SEQ ID NO:502).

```
Primers:
Forward primer T27396 jun43-45F (SEQ ID NO: 500):
CGCTGCCTCAATGGGC

Reverse primer T27396 jun43-45R (SEQ ID NO: 501):
AGGCCACAGCTCGCAGTC

Amplicon T27396 jun43-45 (SEQ ID NO: 502):
CGCTGCCTCAATGGGCTCTGCTTGAGCAAGGGCAACCCTGAGTGTGACGGGAAGGAG

GACTGTAGCGACGGCTCAGATGAGAAGGACTGCGAGCTGTGGCCT
```

Expression of *Homo sapiens* Suppression of Tumorigenicity 14 (Colon Carcinoma, Matriptase, Epithin) T27396 Transcripts which are Detectable by Amplicon as Depicted in Sequence Name T27396 junc43-45 (SEQ ID NO:502) in Normal and Cancerous Prostate Tissues Expression of *Homo sapiens* suppression of tumorigenicity 14 (colon carcinoma, matriptase, epithin) transcripts detectable by or according to junc43-45, T27396 junc43-45 (SEQ ID NO:502) amplicon(s) and primers T27396 junc43-45F (SEQ ID NO:500) and T27396 junc43-45R (SEQ ID NO:501) was measured by real time PCR. In parallel the expression of four housekeeping genes—PBGD (GenBank Accession No. BC019323 (SEQ ID NO:430); amplicon—PBGD—amplicon (SEQ ID NO:433)), HPRT1 (GenBank Accession No. NM_000194 (SEQ ID NO:434); amplicon—HPRT1—amplicon (SEQ ID NO:437)), SDHA (GenBank Accession No. NM_004168 (SEQ ID NO:462); amplicon—SDHA—amplicon (SEQ ID NO:465)), and RPL19 (GenBank Accession No. NM_000981 (SEQ ID NO:450); RPL19 amplicon (SEQ ID NO:453)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 42, 48-53, 59-63, Table 2_1, above "Tissue samples in prostate cancer testing panel"), to obtain a value of fold differential expression for each sample relative to median of the normal PM samples.

In one experiment that was carried out no differential expression in the cancerous samples relative to the normal PM samples was observed. Primer pairs are also optionally and preferably encompassed within the present invention; for example, for the above experiment, the following primer pair was used as a non-limiting illustrative example only of a suitable primer pair: T27396 junc43-45F (SEQ ID NO:500) forward primer; and T27396junc43-45R (SEQ ID NO:501) reverse primer.

The present invention also preferably encompasses any amplicon obtained through the use of any suitable primer pair; for example, for the above experiment, the following amplicon was obtained as a non-limiting illustrative example only of a suitable amplicon: T27396 junc43-45 (SEQ ID NO:502).

mortem (PM) samples (Sample Nos. 42, 48-53, 59-63, Table 2_3, above "Tissue samples in colon cancer testing panel"), to obtain a value of fold differential expression for each sample relative to median of the normal PM samples.

In one experiment that was carried out no differential expression in the cancerous samples relative to the normal PM samples was observed.

Primer pairs are also optionally and preferably encompassed within the present invention; for example, for the

```
Primers:
Forward primer T27396 jun43-45F (SEQ ID NO: 500):
CGCTGCCTCAATGGGC

Reverse primer T27396 jun43-45R (SEQ ID NO: 501):
AGGCCACAGCTCGCAGTC

Amplicon T27396 jun43-45 (SEQ ID NO: 502):
CGCTGCCTCAATGGGCTCTGCTTGAGCAAGGGCAACCCTGAGTGTGACGGGAAGGAG

GACTGTAGCGACGGCTCAGATGAGAAGGACTGCGAGCTGTGGCCT
```

Expression of Homo sapiens suppression of tumorigenicity 14 (colon carcinoma, matriptase, epithin) T27396 transcripts which are detectable by amplicon as depicted in sequence name T27396 junc60-65 (SEQ ID NO:505) in normal and cancerous colon tissues:

Expression of Homo sapiens suppression of tumorigenicity 14 (colon carcinoma, matriptase, epithin) transcripts detectable by or according to junc60-65, T27396 junc60-65 (SEQ ID NO:505) amplicon(s) and primers T27396 junc60-65F (SEQ ID NO:503) and T27396 junc60-65R (SEQ ID 65F above experiment, the following primer pair was used as a non-limiting illustrative example only of a suitable primer pair: T27396 junc60-65F (SEQ ID NO:503) forward primer; and T27396junc60-65R (SEQ ID NO:504) reverse primer.

The present invention also preferably encompasses any amplicon obtained through the use of any suitable primer pair; for example, for the above experiment, the following amplicon was obtained as a non-limiting illustrative example only of a suitable amplicon: T27396 junc60-65 (SEQ ID NO:505).

```
Primers:
Forward primer T27396 junc60-65F (SEQ ID NO: 503):
CCGCGCATGATGGTGA Reverse primer T27396 junc60-65R (SEQ ID NO: 504):
GGAGCCTTGTGTACACGCCT Amplicon T27396 junc60-65 (SEQ ID NO: 505):
CCGCGCATGATGGTGATTCCGGGGGACCCCTGTCCAGCGTGGAGGCGGATGGGCGGA

TCTTCCAGGCCGGTGTGGTGAGCTGGGGAGACGGCTGCGCTCAGAGGAACAAGCCAG

GCGTGTACACAAGGCTCC
```

(SEQ ID NO:503) and T27396 junc60-65R (SEQ ID NO:504) was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), G6PD (GenBank Accession No. NM_000402 (SEQ ID NO:442); G6PD amplicon (SEQ ID NO:445)), RPS27A (GenBank Accession No. NM_002954 (SEQ ID NO:446); RPS27A amplicon (SEQ ID NO:446)) was measured similarly. For each RT sample, the expression of the above amplicon was normalized to the geometric mean of the quantities of the housekeeping genes. The normalized quantity of each RT sample was then divided by the median of the quantities of the normal post- Expression of Homo sapiens suppression of tumorigenicity 14 (colon carcinoma, matriptase, epithin) T27396 transcripts which are detectable by amplicon as depicted in sequence name T27396 junc60-65 (SEQ ID NO:505) in normal and cancerous prostate tissues:

Expression of Homo sapiens suppression of tumorigenicity 14 (colon carcinoma, matriptase, epithin) transcripts detectable by or according to junc60-65, T27396 junc60-65 (SEQ ID NO:505) amplicon(s) and primers T27396 junc60-65F (SEQ ID NO:503) and T27396 junc60-65R (SEQ ID NO:504) was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—

HPRT1-amplicon (SEQ ID NO:437)), SDHA (GenBank Accession No. NM__004168 (SEQ ID NO:462); amplicon—SDHA-amplicon (SEQ ID NO:465)), and RPL19 (GenBank Accession No. NM__000981 (SEQ ID NO:450); RPL19 amplicon (SEQ ID NO:453)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 42, 48-53, 59-63, Table 2__1, above "Tissue samples in prostate cancer testing panel"), to obtain a value of fold differential expression for each sample relative to median of the normal PM samples.

In one experiment that was carried out no differential expression in the cancerous samples relative to the normal PM samples was observed.

Primer pairs are also optionally and preferably encompassed within the present invention; for example, for the above experiment, the following primer pair was used as a non-limiting illustrative example only of a suitable primer pair: T27396 junc60-65F (SEQ ID NO:503) forward primer; and T27396 junc60-65R (SEQ ID NO:504) reverse primer.

The present invention also preferably encompasses any amplicon obtained through the use of any suitable primer pair; for example, for the above experiment, the following amplicon was obtained as a non-limiting illustrative example only of a suitable amplicon: T27396 junc60-65 (SEQ ID NO:505).

transcripts which are detectable by amplicon as depicted in sequence name T27396 junc43-45 (SEQ ID NO:502) in different normal tissues:

Expression of Homo sapiens suppression of tumorigenicity 14 (colon carcinoma, matriptase, epithin) (ST14) transcripts detectable by or according to T27396 junc43-45 (SEQ ID NO:502) amplicon and primers: T27396 junc43-45F (SEQ ID NO:500) and T27396 junc43-45R (SEQ ID NO:501) was measured by real time PCR. In parallel the expression of four housekeeping genes—RPL19 (GenBank Accession No. NM__000981 (SEQ ID NO:450); RPL19 amplicon (SEQ ID NO:453)), TATA box (GenBank Accession No. NM__003194 (SEQ ID NO:454); TATA amplicon (SEQ ID NO:457)), Ubiquitin (GenBank Accession No. BC000449 (SEQ ID NO:458); amplicon—Ubiquitin-amplicon (SEQ ID NO:461)) and SDHA (GenBank Accession No. NM__004168 (SEQ ID NO:462); amplicon—SDHA-amplicon (SEQ ID NO:465)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 19-20 Table 2__6), to obtain a value of relative

```
Primers:
Forward primer T27396 junc60-65F (SEQ ID NO: 503):
CCGCGCATGATGGTGA Reverse primer T27396 junc60-65R (SEQ ID NO: 504):
GGAGCCTTGTGTACACGCCT Amplicon T27396 junc60-65 (SEQ ID NO: 505):
CCGCGCATGATGGTGATTCCGGGGGACCCCTGTCCAGCGTGGAGGCGGATGGGCGGA

TCTTCCAGGCCGGTGTGGTGAGCTGGGGAGACGGCTGCGCTCAGAGGAACAAGCCAG

GCGTGTACACAAGGCTCC
```

Expression of Homo sapiens suppression of tumorigenicity 14 (colon carcinoma, matriptase, epithin) (ST14) T27396 expression of each sample relative to median of the Ovary samples.

```
Primers:
Forward primer T27396 jun43-45F (SEQ ID NO: 500):
CGCTGCCTCAATGGGC

Reverse primer T27396 jun43-45R (SEQ ID NO: 501):
AGGCCACAGCTCGCAGTC

Amplicon T27396 jun43-45 (SEQ ID NO: 502):
CGCTGCCTCAATGGGCTCTGCTTGAGCAAGGGCAACCCTGAGTGTGACGGGAAGGAG

GACTGTAGCGACGGCTCAGATGAGAAGGACTGCGAGCTGTGGCCT
```

Figure 41:
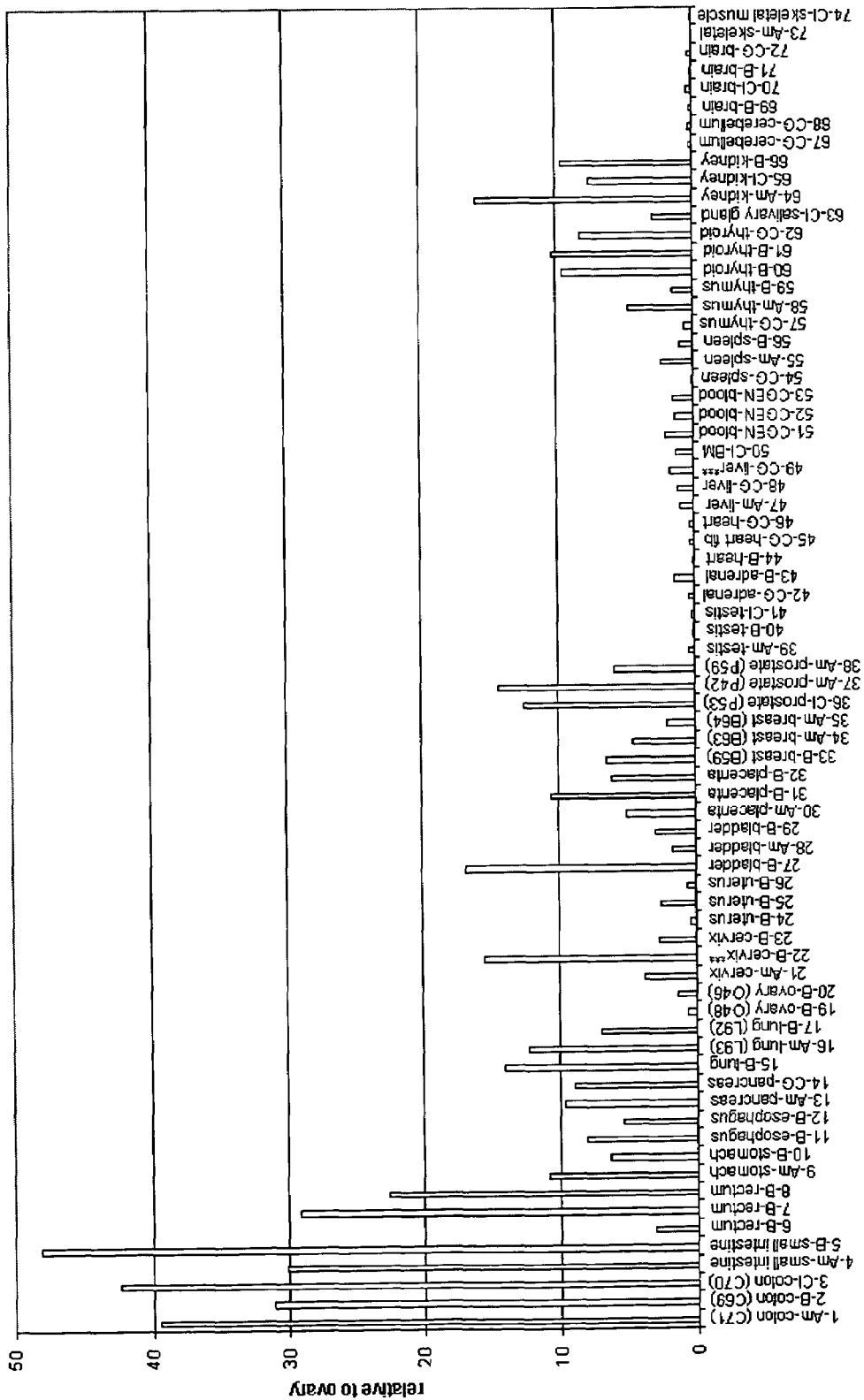
FIG. 41 is a histogram showing over expression of the *Homo sapiens* suppression of tumorigenicity 14 T27396 transcripts which are detectable by amplicon as depicted in sequence name T27396 junc43-45 (SEQ ID NO:502) in different normal tissues.

FIG. 41 is a histogram showing over expression of the Homo sapiens suppression of tumorigenicity 14 T27396 transcripts which are detectable by amplicon as depicted in sequence name T27396 junc43-45 (SEQ ID NO:502) in different normal tissues.

Expression of Homo sapiens suppression of tumorigenicity 14 (colon carcinoma, matriptase, epithin) (ST14) T27396 transcripts which are detectable by amplicon as depicted in sequence name T27396 junc60-65 (SEQ ID NO:505) in different normal tissues:

Expression of Homo sapiens suppression of tumorigenicity 14 (colon carcinoma, matriptase, epithin) (ST14) transcripts detectable by or according to T27396 junc60-65 (SEQ ID NO:505) amplicon and primers: T27396 junc60-65F (SEQ ID NO:503) and T27396 junc60-65R (SEQ ID NO:504) was measured by real time PCR. In parallel the expression of four housekeeping genes—RPL19 (GenBank Accession No. NM_000981 (SEQ ID NO:450); RPL19 amplicon (SEQ ID NO:453)), TATA box (GenBank Accession No. NM_003194 (SEQ ID NO:454); TATA amplicon (SEQ ID NO:457)), Ubiquitin (GenBank Accession No. BC000449 (SEQ ID NO:458); amplicon—Ubiquitin-amplicon (SEQ ID NO:461)) and SDHA (GenBank Accession No. NM_004168 (SEQ ID NO:462); amplicon—SDHA-amplicon (SEQ ID NO:465)) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 19-20 Table 2_6), to obtain a value of relative expression of each sample relative to median of the Ovary samples.

Primers:
Forward primer T27396 junc60-65F (SEQ ID NO: 503):
CCGCGCATGATGGTGA

Reverse primer T27396 junc60-65R (SEQ ID NO: 504):
GGAGCCTTGTGTACACGCCT

Amplicon T27396 junc60-65 (SEQ ID NO: 505):
CCGCGCATGATGGTGATTCCGGGGGACCCCTGTCCAGCGTGGAGGCGGATGGGCGGA

TCTTCCAGGCCGGTGTGGTGAGCTGGGGAGACGGCTGCGCTCAGAGGAACAAGCCAG

GCGTGTACACAAGGCTCC

Figure 42:
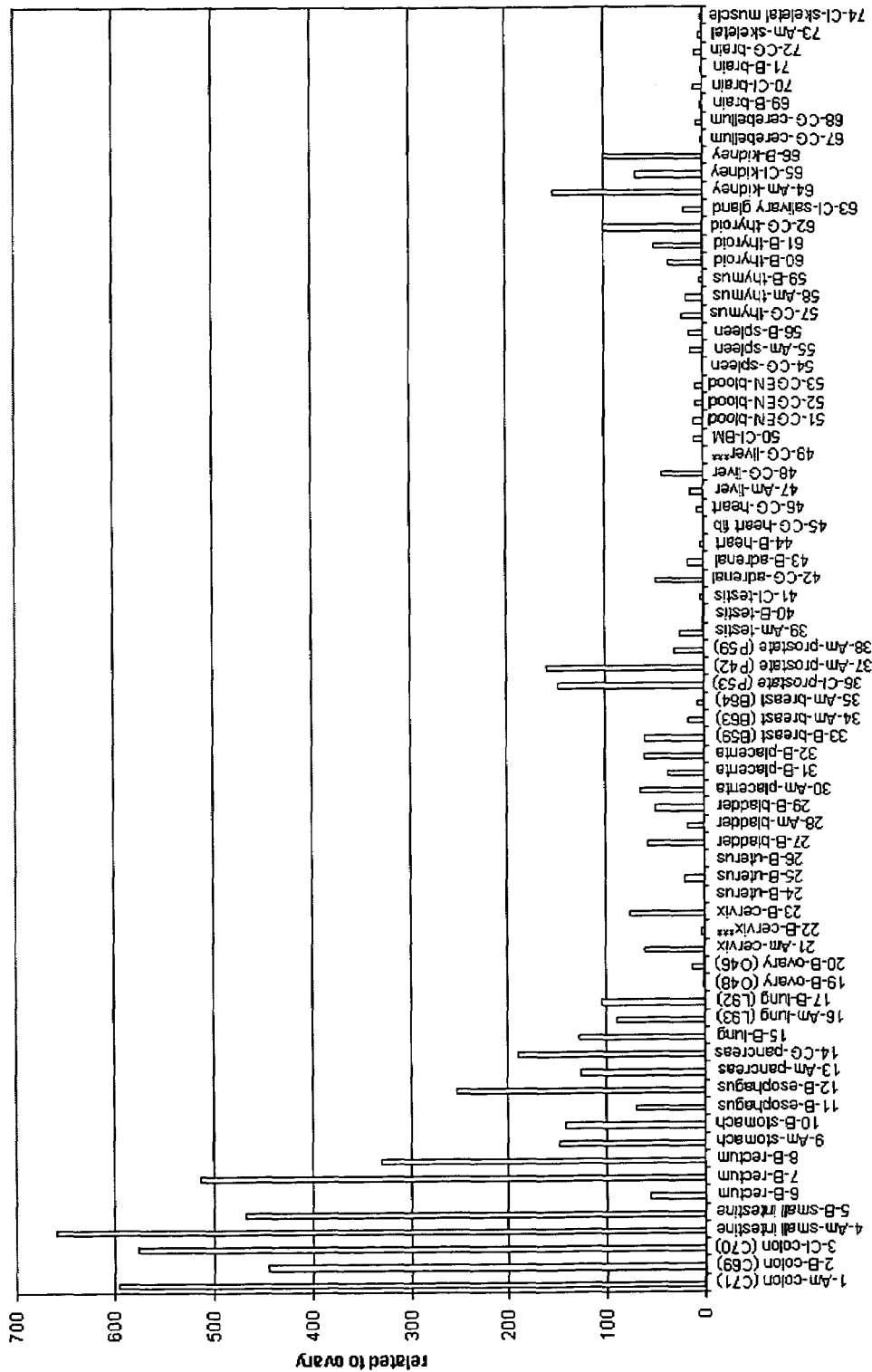
FIG. 42 is a histogram showing over expression of the *Homo sapiens* suppression of tumorigenicity 14 T27396 transcripts which are detectable by amplicon as depicted in sequence name T27396 junc60-65 (SEQ ID NO:505) in different normal tissues.

FIG. 42 is a histogram showing over expression of the Homo sapiens suppression of tumorigenicity 14 T27396 transcripts which are detectable by amplicon as depicted in sequence name T27396 junc60-65 (SEQ ID NO:505) in different normal tissues.

Description for Cluster T51958

Cluster T51958 features 12 transcript(s) and 47 segment(s) of interest, the names for which are given in Tables 423 and 424, respectively, the sequences themselves are given at the end of the application. The selected protein variants are given in table 425.

TABLE 423

Transcripts of interest
Transcript Name

T51958_T1 (SEQ ID NO: 350)
T51958_T2 (SEQ ID NO: 351)
T51958_T7 (SEQ ID NO: 352)
T51958_T8 (SEQ ID NO: 353)
T51958_T10 (SEQ ID NO: 354)
T51958_T12 (SEQ ID NO: 355)
T51958_T13 (SEQ ID NO: 356)
T51958_T17 (SEQ ID NO: 357)
T51958_T31 (SEQ ID NO: 358)
T51958_T37 (SEQ ID NO: 359)
T51958_T38 (SEQ ID NO: 360)
T51958_T40 (SEQ ID NO: 361)

TABLE 423-continued

Transcripts of interest
Transcript Name

T51958_T5 (SEQ ID NO: 631)
T51958_T20 (SEQ ID NO: 632)

TABLE 424

Segments of interest
Segment Name

T51958_N0 (SEQ ID NO: 362)
T51958_N4 (SEQ ID NO: 363)
T51958_N5 (SEQ ID NO: 364) (also called T51958 seg7)
T51958_N10 (SEQ ID NO: 365)
T51958_N12 (SEQ ID NO: 366)
T51958_N14 (SEQ ID NO: 367)
T51958_N17 (SEQ ID NO: 368) (also called T51958 seg21)
T51958_N18 (SEQ ID NO: 369)
T51958_N21 (SEQ ID NO: 370)
T51958_N24 (SEQ ID NO: 371)
T51958_N26 (SEQ ID NO: 372)

TABLE 424-continued

Segments of interest
Segment Name

T51958_N30 (SEQ ID NO: 373) (also called T51958 seg33)
T51958_N37 (SEQ ID NO: 374)
T51958_N42 (SEQ ID NO: 375) (also called T51958 seg38)
T51958_N48 (SEQ ID NO: 376)
T51958_N51 (SEQ ID NO: 377)
T51958_N52 (SEQ ID NO: 378)
T51958_N53 (SEQ ID NO: 379)
T51958_N61 (SEQ ID NO: 380)
T51958_N64 (SEQ ID NO: 381)
T51958_N68 (SEQ ID NO: 382)
T51958_N72 (SEQ ID NO: 383)
T51958_N7 (SEQ ID NO: 384)
T51958_N11 (SEQ ID NO: 385)
T51958_N16 (SEQ ID NO: 386)
T51958_N23 (SEQ ID NO: 387)
T51958_N32 (SEQ ID NO: 388)
T51958_N33 (SEQ ID NO: 389)
T51958_N35 (SEQ ID NO: 390)
T51958_N36 (SEQ ID NO: 391)
T51958_N38 (SEQ ID NO: 392)
T51958_N39 (SEQ ID NO: 393)
T51958_N40 (SEQ ID NO: 394)
T51958_N41 (SEQ ID NO: 395)
T51958_N43 (SEQ ID NO: 396)

TABLE 424-continued

Segments of interest
Segment Name

T51958_N44 (SEQ ID NO: 397)
T51958_N45 (SEQ ID NO: 398)
T51958_N46 (SEQ ID NO: 399)
T51958_N47 (SEQ ID NO: 400)
T51958_N49 (SEQ ID NO: 401)
T51958_N50 (SEQ ID NO: 402)
T51958_N56 (SEQ ID NO: 403)
T51958_N65 (SEQ ID NO: 404)
T51958_N66 (SEQ ID NO: 405)
T51958_N69 (SEQ ID NO: 406)
T51958_N70 (SEQ ID NO: 407)
T51958_N71 (SEQ ID NO: 408)

TABLE 425

Proteins of interest

| Protein Name | Corresponding Transcript(s) |
|---|---|
| T51958_P1 (SEQ ID NO: 423) | T51958_T1 (SEQ ID NO: 350); T51958_T10 (SEQ ID NO: 354); T51958_T12 (SEQ ID NO: 355); T51958_T31 (SEQ ID NO: 358) |
| T51958_P8 (SEQ ID NO: 424) | T51958_T8 (SEQ ID NO: 353) |
| T51958_P13 (SEQ ID NO: 425) | T51958_T17 (SEQ ID NO: 357) |
| T51958_P27 (SEQ ID NO: 426) | T51958_T37 (SEQ ID NO: 359); T51958_T38 (SEQ ID NO: 360) |
| T51958_P29 (SEQ ID NO: 427) | T51958_T40 (SEQ ID NO: 361) |
| T51958_P59 (SEQ ID NO: 428) | T51958_T2 (SEQ ID NO: 351) |
| T51958_P60 (SEQ ID NO: 429) | T51958_T13 (SEQ ID NO: 356); T51958_T7 (SEQ ID NO: 352) |
| T51958_P5 (SEQ ID NO: 633) | T51958_T20 (SEQ ID NO: 632); T51958_T5 (SEQ ID NO: 631) |

These sequences are variants of the known protein Tyrosine-protein kinase-like 7 precursor (SEQ ID NO:409) (SwissProt accession identifier PTK7_HUMAN (SEQ ID NO:595); known also according to the synonyms Colon carcinoma kinase-4; CCK-4), referred to herein as the previously known protein.

Protein Tyrosine-protein kinase-like 7 precursor (SEQ ID NO:409) is known or believed to have the following function(s): May function as a cell adhesion molecule. Lacks probably the catalytic activity of tyrosine kinase. May be connected to the pathophysiology of colon carcinomas and/or may represent a tumor progression marker. The sequence for protein Tyrosine-protein kinase-like 7 precursor (SEQ ID NO:409) is given at the end of the application, as "Tyrosine-protein kinase-like 7 precursor (SEQ ID NO:409) amino acid sequence". Known polymorphisms for this sequence are as shown in Table 426.

TABLE 426

Amino acid mutations for Known Protein

| SNP position(s) on amino acid sequence | Comment |
|---|---|
| 92 | P -> R |
| 147 | K -> T |
| 207 | S -> G |
| 495-496 | VL -> RV |
| 515 | G -> E |
| 881 | E -> G |
| 969 | A -> P |
| 992 | S -> F |

Protein Tyrosine-protein kinase-like 7 precursor (SEQ ID NO:409) localization is believed to be Type I membrane protein.

The following GO Annotation(s) apply to the previously known protein. The following annotation(s) were found: signal transduction, which are annotation(s) related to Biological Process; transmembrane receptor protein tyrosine kinase activity, which are annotation(s) related to Molecular Function; and integral to plasma membrane, which are annotation(s) related to Cellular Component.

The GO assignment relies on information from one or more of the SwissProt/TremB1 Protein knowledgebase, available from.expasy.ch/sprot/>; or Locuslink, available from.ncbi .nlm.nih.gov/projects/LocusLink/>.

Cluster T51958 can be used as a diagnostic marker according to overexpression of transcripts of this cluster in cancer. Expression of such transcripts in normal tissues is also given according to the previously described methods. The term "number" in the left hand column of the table and the numbers on the y-axis of the figure below refer to weighted expression of ESTs in each category, as "parts per million" (ratio of the expression of ESTs for a particular cluster to the expression of all ESTs in that category, according to parts per million).

Figure 43:
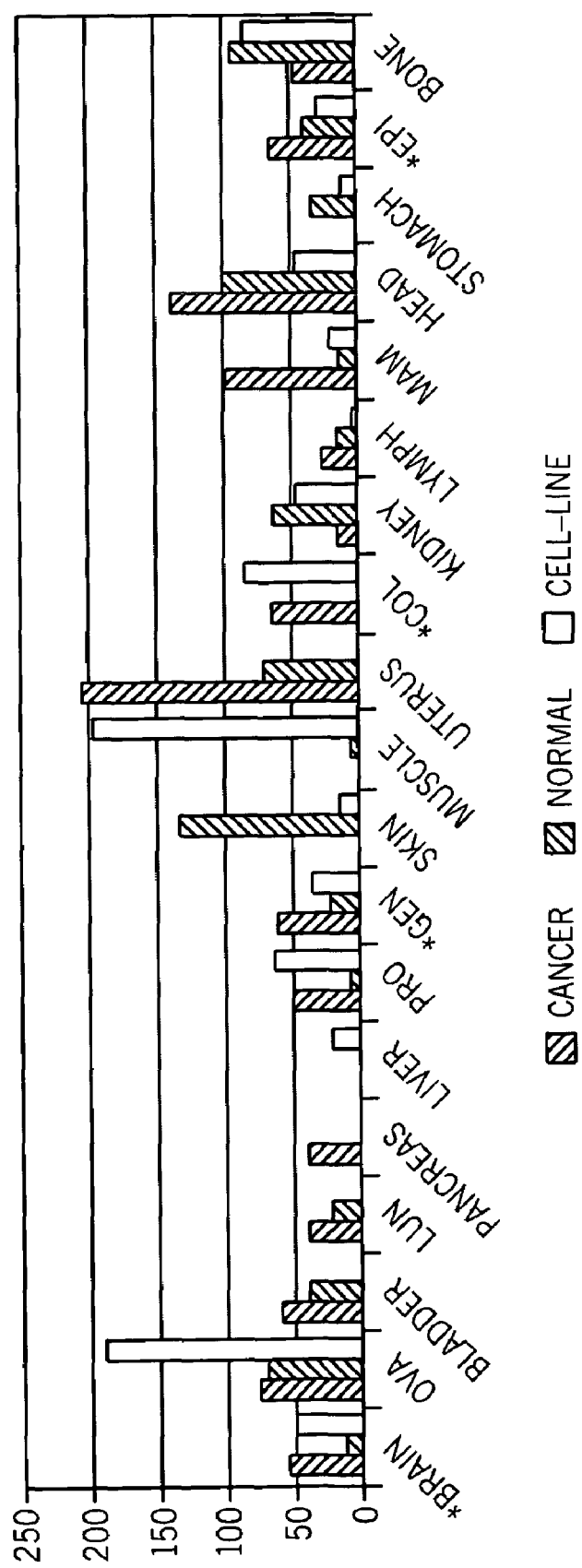
FIG. 43 is a histogram showing Cancer and cell-line vs. normal tissue expression for Cluster T51958, demonstrating overexpression in epithelial malignant tumors and a mixture of malignant tumors from different tissues.

Overall, the following results were obtained as shown with regard to the histograms in FIG. 43 and Table 427. This cluster is overexpressed (at least at a minimum level) in the following pathological conditions: brain malignant tumors, a mixture of malignant tumors from different tissues, colorectal cancer and epithelial malignant tumors.

TABLE 427

Normal tissue distribution

| Name of Tissue | Number |
|---|---|
| brain | 13 |
| ovary | 72 |
| bladder | 41 |
| lung | 23 |
| pancreas | 0 |
| liver | 0 |
| prostate | 7 |
| general | 24 |
| skin | 133 |
| muscle | 7 |
| uterus | 71 |
| colon | 0 |
| kidney | 65 |
| lymph nodes | 18 |
| breast | 12 |
| head and neck | 101 |
| stomach | 36 |
| epitheilal | 40 |
| bone | 94 |

TABLE 428

P values and ratios for expression in cancerous tissue

| Name of Tissue | P1 | P2 | SP1 | R3 | SP2 | R4 |
|---|---|---|---|---|---|---|
| brain | 3.1e-02 | 6.8e-03 | 2.4e-02 | 3.7 | 4.7e-03 | 3.2 |
| ovary | 3.7e-01 | 2.5e-01 | 7.1e-01 | 1.0 | 4.5e-01 | 1.2 |
| bladder | 5.4e-01 | 6.3e-01 | 6.0e-01 | 1.3 | 7.6e-01 | 1.0 |
| lung | 5.4e-01 | 8.1e-01 | 5.4e-01 | 1.5 | 8.4e-01 | 0.8 |
| pancreas | 1.1e-01 | 1.9e-01 | 7.6e-02 | 5.1 | 1.5e-01 | 3.7 |
| liver | N/A | 6.9e-01 | N/A | N/A | 7.0e-01 | 1.4 |
| prostate | 5.8e-01 | 4.7e-01 | 1.3e-01 | 2.5 | 9.8e-02 | 2.7 |
| general | 1.3e-07 | 5.0e-07 | 4.1e-07 | 2.4 | 1.4e-05 | 1.9 |
| skin | 8.0e-01 | 8.4e-01 | 1.0e+00 | 0.1 | 1.0e+00 | 0.2 |
| muscle | 9.2e-01 | 4.8e-01 | N/A | N/A | 9.6e-03 | 2.9 |

TABLE 428-continued

P values and ratios for expression in cancerous tissue

| Name of Tissue | P1 | P2 | SP1 | R3 | SP2 | R4 |
|---|---|---|---|---|---|---|
| uterus | 1.7e−01 | 4.9e−01 | 4.1e−02 | 1.8 | 3.7e−01 | 1.0 |
| colon | 9.6e−03 | 7.7e−03 | 2.3e−01 | 3.2 | 1.6e−01 | 3.1 |
| kidney | 6.1e−01 | 4.2e−01 | 9.7e−01 | 0.4 | 9.3e−01 | 0.6 |
| lymph nodes | 5.8e−01 | 6.2e−01 | 1.0e+00 | 1.2 | 1.0e+00 | 0.8 |
| breast | 4.0e−01 | 3.7e−01 | 1.5e−01 | 2.5 | 3.1e−01 | 1.8 |
| head and neck | 3.4e−01 | 3.3e−01 | 7.3e−01 | 1.2 | 8.5e−01 | 0.9 |
| stomach | 5.5e−01 | 7.1e−01 | 1.0e+00 | 0.5 | 9.6e−01 | 0.6 |
| epithelial | 2.2e−03 | 9.5e−03 | 1.8e−02 | 1.5 | 1.9e−01 | 1.1 |
| bone | 6.6e−01 | 5.5e−01 | 8.7e−01 | 0.6 | 8.0e−01 | 0.7 |

As noted above, cluster T51958 features 12 transcript(s), which were listed in Table 423 above. These transcripts(s) encode for protein(s) which are variant(s) of protein Tyrosine-protein kinase-like 7 precursor (SEQ ID NO:409). A description of each variant protein according to the present invention is now provided.

Variant protein T51958_P1 (SEQ ID NO:423) according to the present invention has an amino acid sequence as given at the end of the application; it is encoded by transcript(s) T51958_T1 (SEQ ID NO:350), T51958_T10 (SEQ ID NO:354), T51958_T12 (SEQ ID NO:355) and T51958_T31 (SEQ ID NO:358). An alignment is given to the known protein (Tyrosine-protein kinase-like 7 precursor (SEQ ID NO:409)) at the end of the application. One or more alignments to one or more previously published protein sequences are given at the end of the application. A brief description of the relationship of the variant protein according to the present invention to each such aligned protein is as follows:

1. Comparison Report Between T51958_P1 (SEQ ID NO:423) and PTK7_HUMAN (SEQ ID NO:595):

A. An isolated chimeric polypeptide encoding for T51958_P1 (SEQ ID NO:423), comprising a first amino acid sequence being at least 90% homologous to MGAARGSPARPRRLPLLSVLLLPLLG-GTQTAIVFIKQPSSQDALQGRRALLRCEVEAPGPV HVYWLLDGAPVQDTERRFAQGSSLSFAAVD corresponding to amino acids 1-91 of PTK7_HUMAN (SEQ ID NO:595), which also corresponds to amino acids 1-91 of T51958_P1 (SEQ ID NO:423), a bridging amino acid R corresponding to amino acid 92 of T51958_P1 (SEQ ID NO:423), a second amino acid sequence being at least 90% homologous to LQDSGTFQCVARDDVTGEEARSANASFNIKWIEAGPVVLKHPASEAEIQPQTQV corresponding to amino acids 93-146 of PTK7_HUMAN (SEQ ID NO:595), which also corresponds to amino acids 93-146 of T51958_P1 (SEQ ID NO:423), a bridging amino acid T corresponding to amino acid 147 of T51958_P1 (SEQ ID NO:423), a third amino acid sequence being at least 90% homologous to LRCHIDGHPRPTYQWFRDGTPLSDGQS-NHTVSSKERNLTLRPAGPEHSGLYSCCAHSAF corresponding to amino acids 148-206 of PTK7_HUMAN (SEQ ID NO:595), which also corresponds to amino acids 148-206 of T51958_P1 (SEQ ID NO:423), a bridging amino acid G corresponding to amino acid 207 of T51958_P1 (SEQ ID NO:423), a fourth amino acid sequence being at least 90% homologous to QACSSQNFTLSIADESFARVVLAPQDVVARYEEAMFHCQFSAQPPPSLQWLFEDETPITNRSRPPHLRRATVFANGSLLLTQVR-PRNAGIYRCIGQGQRGPPIILEATLHLAEIEDMPLFEP RVFTAGSEERVTCLPPKGLPEPSVVWWE-HAGVRLPTHGRVYQKGHELVLANIAESDAGVY TCHAANLAGQRRQDVNIT-VATVPSWLKKPQDSQLEEGKPGYLD-CLTQATPKPTVVWYR NQMLISEDSRFEVFKNGTL-RINSVEVYDGTWYRCMSSTPAGSIEAQA corresponding to amino acids 208-494 of PTK7_HUMAN (SEQ ID NO:595), which also corresponds to amino acids 208-494 of T51958_P1 (SEQ ID NO:423), bridging amino acids RV corresponding to amino acid 495-496 of T51958_P1 (SEQ ID NO:423), a fifth amino acid sequence being at least 90% homologous to QVLEKLKFTPP-PQPQQCM corresponding to amino acids 497-514 of PTK7_HUMAN (SEQ ID NO:595), which also corresponds to amino acids 497-514 of T51958_P1 (SEQ ID NO:423), a bridging amino acid E corresponding to amino acid 515 of T51958_P1 (SEQ ID NO:423), a sixth amino acid sequence being at least 90% homologous to FDKEATVPCSATGREKPTIKWERADGSSLPEWVTDNAGTLHFARV-TRDDAGNYTCIASN GPQGQIRAHVQLTVAVFIT-FKVEPERTTVYQGHTALLQCEAQGDPK-PLIQWKGKDRILDP TKLGPRMHIFQNGSLVIHDVA-PEDSGRYTCIAGNSCNIKHTEAPLYVV corresponding to amino acids 516-682 of PTK7_HUMAN (SEQ ID NO:595), which also corresponds to amino acids 516-682 of T51958_P1 (SEQ ID NO:423), and a seventh amino acid sequence being at least 70%, optionally at least 80%, preferably at least 85%, more preferably at least 90% and most preferably at least 95% homologous to a polypeptide having the sequence GMGWGGLCCTGSGGPRRLSPCTQ-PLCTEHGTEAIFVAAVGIRPSHHAAAQS (SEQ ID NO:618) corresponding to amino acids 683-733 of T51958_P1 (SEQ ID NO:423), wherein said first amino acid sequence, bridging amino acid, second amino acid sequence, bridging amino acid, third amino acid sequence, bridging amino acid, fourth amino acid sequence, bridging amino acid, fifth amino acid sequence, bridging amino acid, sixth amino acid sequence and seventh amino acid sequence are contiguous and in a sequential order.

B. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQ-PLCTEHGTEAIFVAAVGIRPSHHAAAQS (SEQ ID NO:618) of T51958_P1 (SEQ ID NO:423).

2. Comparison Report Between T51958_P1 (SEQ ID NO:423) and Q8NFA5_HUMAN (SEQ ID NO:420):

A. An isolated chimeric polypeptide encoding for T51958_P1 (SEQ ID NO:423), comprising a first amino acid sequence being at least 90% homologous to MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VVWWEHAGVRL PTHGRVYQKGHELVLANIAESDAG-VYTCHAANLAGQRRQDVNITVATVPSWLKKPQDS QLEEGKPGYLDCLTQATPKPTVVWYRN-QMLISEDSRFEVFKNGTLRINSVEVYDGTWYR CMSSTPAGSIEAQARVQVLEKLKFTPP- PQPQQCMEFDKEATVPCSATGREKPTIKWERAD GSSLPEWVTDNAGTLHFARVTRDDAGNYTCIASNGPQGQIRAHVQLTVAVFITFKVEPER TTVYQGHTALLQCEAQGDPKPLIQWKGKDRILDPTKLGPRMHIFQNGSLVIHDVAPEDSG RYTCIAGNSCNIKHTEAPLYVV corresponding to amino acids 1-682 of Q8NFA5_HUMAN (SEQ ID NO:420), which also corresponds to amino acids 1-682 of T51958_P1 (SEQ ID NO:423), and a second amino acid sequence being at least 70%, optionally at least 80%, preferably at least 85%, more preferably at least 90% and most preferably at least 95% homologous to a polypeptide having the sequence GMGWGGLCCTGSGGPRRLSPCTQPLCTEHGTEAIFVAAVGIRPSHHAAAQS (SEQ ID NO:618) corresponding to amino acids 683-733 of T51958_P1 (SEQ ID NO:423), wherein said first amino acid sequence and second amino acid sequence are contiguous and in a sequential order.

B. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQPLCTEHGTEAIFVAAVGIRPSHHAAAQS (SEQ ID NO:618) of T51958_P1 (SEQ ID NO:423).

3. Comparison Report Between T51958_P1 (SEQ ID NO:423) and NP_690622 (SEQ ID NO:414):

A. An isolated chimeric polypeptide encoding for T51958_P1 (SEQ ID NO:423), comprising a first amino acid sequence being at least 90% homologous to MGAARGSPARPRRLPLLSVLLLPLLGGTQTAIVFIKQPSSQDALQGRRALLRCEVEAPGPV HVYWLLDGAPVQDTERRFAQGSSLSFAAVDRLQDSGTFQCVARDDVTGEEARSANASFN IKWIEAGPVVLKHPASEAEIQPQTQVTLRCHIDGHPRPTYQWFRDGTPLSDGQSNHTVSSK ERNLTLRPAGPEHSGLYSCCAHSAFGQACSSQNFTLSIADESFARVVLAPQDVVVARYEE AMFHCQFSAQPPPSLQWLFEDETPITNRSRPPHLRRATVFANGSLLLTQVRPRNAGIYRCI GQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYR CMSSTPAGSIEAQARVQVLEKLKFTPPPQPQQCMEFDKEATVPCSATGREKPTIKWERAD GSSLPEWVTDNAGTLHFARVTRDDAGNYTCIASNGPQGQIRAHVQLTVAVFITFKVEPER TTVYQGHTALLQCEAQGDPKPLIQWKGKDRILDPTKLGPRMHIFQNGSLVIHDVAPEDSG RYTCIAGNSCNIKHTEAPLYVV corresponding to amino acids 1-682 of NP_690622 (SEQ ID NO:414), which also corresponds to amino acids 1-682 of T51958_P1 (SEQ ID NO:423), and a second amino acid sequence being at least 70%, optionally at least 80%, preferably at least 85%, more preferably at least 90% and most preferably at least 95% homologous to a polypeptide having the sequence GMGWGGLCCTGSGGPRRLSPCTQPLCTEHGTEAIFVAAVGIRPSHHAAAQS (SEQ ID NO:618) corresponding to amino acids 683-733 of T51958_P1 (SEQ ID NO:423), wherein said first amino acid sequence and second amino acid sequence are contiguous and in a sequential order.

B. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQPLCTEHGTEAIFVAAVGIRPSHHAAAQS (SEQ ID NO:618) of T51958_P1 (SEQ ID NO:423).

4. Comparison Report Between T51958_P1 (SEQ ID NO:423) and NP_002812 (SEQ ID NO:413):

A. An isolated chimeric polypeptide encoding for T51958_P1 (SEQ ID NO:423), comprising a first amino acid sequence being at least 90% homologous to MGAARGSPARPRRLPLLSVLLLPLLGGTQTAIVFIKQPSSQDALQGRRALLRCEVEAPGPV HVYWLLDGAPVQDTERRFAQGSSLSFAAVDRLQDSGTFQCVARDDVTGEEARSANASFN IKWEEAGPVVLKHPASEAEIQPQTQVTLRCHIDGHPRPTYQWFRDGTPLSDGQSNHTVSSK ERNLTLRPAGPEHSGLYSCCAHSAFGQACSSQNFTLSIADESFARVVLAPQDVVVARYEE AMFHCQFSAQPPPSLQWLFEDETPITNRSRPPHLRRATVFANGSLLLTQVRPRNAGIYRCI GQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYR CMSSTPAGSIEAQARVQVLEKLKFTPPPQPQQCMEFDKEATVPCSATGREKPTIKWERAD GSSLPEWVTDNAGTLHFARVTRDDAGNYTCIASNGPQGQIRAHVQLTVAVFITFKVEPER TTVYQGHTALLQCEAQGDPKPLIQWKGKDRILDPTKLGPRMHIFQNGSLVIHDVAPEDSG RYTCIAGNSCNIKHTEAPLYVV corresponding to amino acids 1-682 of NP_002812 (SEQ ID NO:413), which also corresponds to amino acids 1-682 of T51958_P1 (SEQ ID NO:423), and a second amino acid sequence being at least 70%, optionally at least 80%, preferably at least 85%, more preferably at least 90% and most preferably at least 95% homologous to a polypeptide having the sequence GMGWGGLCCTGSGGPRRLSPCTQPLCTEHGTEAIFVAAVGIRPSHHAAAQS (SEQ ID NO:618) corresponding to amino acids 683-733 of T51958_P1 (SEQ ID NO:423), wherein said first amino acid sequence and second amino acid sequence are contiguous and in a sequential order.

B. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQPLCTEHGTEAIFVAAVGIRPSHHAAAQS (SEQ ID NO:618) of T51958_P1 (SEQ ID NO:423).

5. Comparison Report Between T51958_P1 (SEQ ID NO:423) and Q6IQ54_HUMAN (SEQ ID NO:419):

A. An isolated chimeric polypeptide encoding for T51958_P1 (SEQ ID NO:423), comprising a first amino acid sequence being at least 90% homologous to MGAARGSPARPRRLPLLSVLLLPLLGGTQTAIVFIKQPSSQDALQGRRALLRCEVEAPGPV HVYWLLDGAPVQDTERRFAQGSSLSFAAVDR corresponding to amino acids 1-92 of Q6IQ54_HUMAN (SEQ ID NO:419), which also corresponds to amino acids 1-92 of T51958_P1 (SEQ ID NO:423), a bridging amino acid L corresponding to amino acid 93 of T51958_P1 (SEQ ID NO:423), a second amino acid sequence being at least 90% homologous to QDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQ NFTLSIADESFARVVLAPQDVVVARYEEAMFHCQFSAQPPPSLQWLFEDETPITNRSRPPH LRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSEEAQARVQVLEKLKFTPPPQPQQCM EFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVV corresponding to amino acids 94-682 of Q6IQ54_HUMAN (SEQ ID NO:419), which also corresponds to amino acids 94-682 of T51958_P1 (SEQ ID NO:423), and a third amino acid sequence being at least 70%, optionally at least 80%, preferably at least 85%, more preferably at least 90% and most preferably at least 95% homologous to a polypeptide having the sequence GMGWGGLCCTGSGGPRRLSPCTQPLCTEHGTEAIFVAAVGIRPSHHAAAQS (SEQ ID NO:618) corresponding to amino acids 683-733 of T51958_P1 (SEQ ID NO:423), wherein said first amino acid sequence, bridging amino acid, second amino acid sequence and third amino acid sequence are contiguous and in a sequential order.

B. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQPLCTEHGTEAIFVAAVGIRPSHHAAAQS (SEQ ID NO:618) of T51958_P1 (SEQ ID NO:423).

6. Comparison Report Between T51958_P1 (SEQ ID NO:423) and NP_690619 (SEQ ID NO:412):

A. An isolated chimeric polypeptide encoding for T51958_P1 (SEQ ID NO:423), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSEEAQARVQVL corresponding to amino acids 1-499 of NP_690619 (SEQ ID NO:412), which also corresponds to amino acids 1-499 of T51958_P1 (SEQ ID NO:423), a second amino acid sequence being at least 70%, optionally at least 80%, preferably at least 85%, more preferably at least 90% and most preferably at least 95% homologous to a polypeptide having the sequence EKLKFTPPPQPQQCMEFDKEATVPCSATGREKPTIKWERA (SEQ ID NO:619) corresponding to amino acids 500-539 of T51958_P1 (SEQ ID NO:423), a third amino acid sequence being at least 90% homologous to DGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVV corresponding to amino acids 500-642 of NP_690619 (SEQ ID NO:412), which also corresponds to amino acids 540-682 of T51958_P1 (SEQ ID NO:423), and a fourth amino acid sequence being at least 70%, optionally at least 80%, preferably at least 85%, more preferably at least 90% and most preferably at least 95% homologous to a polypeptide having the sequence GMGWGGLCCTGSGGPRRLSPCTQPLCTEHGTEAIFVAAVGIRPSHHAAAQS (SEQ ID NO:618) corresponding to amino acids 683-733 of T51958_P1 (SEQ ID NO:423), wherein said first amino acid sequence, second amino acid sequence, third amino acid sequence and fourth amino acid sequence are contiguous and in a sequential order.

B. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence EKLKFTPPPQPQQCMEFDKEATVPCSATGREKPTIKWERA (SEQ ID NO:619) of T51958_P1 (SEQ ID NO:423).

C. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQPLCTEHGTEAIFVAAVGIRPSHHAAAQS (SEQ ID NO:618) of T51958_P1 (SEQ iID NO:423).

7. Comparison Report Between T51958_P1 (SEQ ID NO:423) and Q8NFA8_HUMAN (SEQ ID NO:416):

A. An isolated chimeric polypeptide encoding for T51958_P1 (SEQ ID NO:423), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVL corresponding to amino acids 1-499 of Q8NFA8_HUMAN (SEQ ID NO:416), which also corresponds to amino acids 1-499 of T51958_P1 (SEQ ID NO:423), a second amino acid sequence being at least 70%, optionally at least 80%, preferably at least 85%, more preferably at least 90% and most preferably at least 95% homologous to a polypeptide having the sequence EKLKFTPPPQPQQCMEFDKEATVPCSATGREKPTIKWERA (SEQ ID NO:619) corresponding to amino acids 500-539 of T51958_P1 (SEQ ID NO:423), a third amino acid sequence being at least 90% homologous to DGSSLPEWVTDNAGTLHFARVTRDDAGNYTCIASNGPQGQIPAHVQLTVAVFITFKVEPE RTTVYQGHTALLQCEAQGDPKPLIQWKGKDRILDPTKLGPRMHIFQNGSLVIHDVAPEDS GRYTCIAGNSCNIKHTEAPLYVV corresponding to amino acids 500-642 of Q8NFA8_HUMAN (SEQ ID NO:416), which also corresponds to amino acids 540-682 of T51958_P1 (SEQ ID NO:423), and a fourth amino acid sequence being at least 70%, optionally at least 80%, preferably at least 85%, more preferably at least 90% and most preferably at least 95% homologous to a polypeptide having the sequence GMGWGGLCCTGSGGPRRLSPCTQPLCTEHGTEAIFVAAVGIRPSHHAAAQS (SEQ ID NO:618) corresponding to amino acids 683-733 of T51958_P1 (SEQ ID NO:423), wherein said first amino acid sequence, second amino acid sequence, third amino acid sequence and fourth amino acid sequence are contiguous and in a sequential order.

B. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence EKLKFTPPPQPQQCMEFDKEATVPCSATGREKPTIKWERA (SEQ ID NO:619) of T51958_P1 (SEQ ID NO:423).

C. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQPLCTEHGTEAIFVAAVGIRPSHHAAAQS (SEQ ID NO:618) of T51958_P1 (SEQ ID NO:423).

8. Comparison Report Between T51958_P1 (SEQ ID NO:423) and Q8NFA6_HUMAN (SEQ ID NO:418):

A. An isolated chimeric polypeptide encoding for T51958_P1 (SEQ ID NO:423), comprising a first amino acid sequence being at least 90% homologous to MGAARGSPARPRRLPLLSVLLLPLLGGTQTAIVFIKQPSSQDALQGRRALLRCEVEAPGPV HVYWLLDGAPVQDTERRFAQGSSLSFAAVDRLQDSGTFQCVARDDVTGEEARSANASFN IKWIEAGPVVLKHPASEAEIQPQTQVTLRCHIDGHPRPTYQWFRDGTPLSDGQSNHTVSSK ERNLTLRPAGPEHSGLYSCCAHSAFGQACSSQNFTLSIADESFARVVLAPQDVVVARYEE AMFHCQFSAQPPPSLQWLFEDETPITNRSRPPHLRRATVFANGSLLLTQVRPRNAGIYRCI GQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYR CMSSTPAGSIEAQARVQVLEKLKFTPPPQPQQCMEFDKEATVPCSATGREKPTIKWERAD GSSLPEWVTDNAGTLHFARVTRDDAGNYTCIASNGPQGQIRAHVQLTVAVFITFKVEPER TTVYQGHTALLQCEAQGDPKPLIQWK corresponding to amino acids 1-626 of Q8NFA6_HUMAN (SEQ ID NO:418), which also corresponds to amino acids 1-626 of T51958_P1 (SEQ ID NO:423), and a second amino acid sequence being at least 70%, optionally at least 80%, preferably at least 85%, more preferably at least 90% and most preferably at least 95% homologous to a polypeptide having the sequence GKDRILDPTKLGPRMHIFQNGSLVIHDVAPEDSGRYTCIAGNSCNIKHTEAPLYVVGMGW GGLCCTGSGGPRRLSPCTQPLCTEHGTEAIFVAAVGIRPSHHAAAQS (SEQ ID NO:620) corresponding to amino acids 627-733 of T51958_P1 (SEQ ID NO:423), wherein said first amino acid sequence and second amino acid sequence are contiguous and in a sequential order.

B. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GKDRILDPTKLGPRMHIFQNGSLVIHDVAPEDSGRYTCIAGNSCNIKHTEAPLYVVGMGW GGLCCTGSGGPRRLSPCTQPLCTEHGTEAIFVAAVGIRPSHHAAAQS (SEQ ID NO:620) of T51958_P1 (SEQ ID NO:423).

9. Comparison Report Between T51958_P1 (SEQ ID NO:423) and NP_690621 (SEQ ID NO:410):

A. An isolated chimeric polypeptide encoding for T51958_P1 (SEQ ID NO:423), comprising a first amino acid sequence being at least 90% homologous to MGAARGSPARPRRLPLLSVLLLPLLGGTQTAIVFIKQPSSQDALQGRRALLRCEVEAPGPV HVYWLLDGAPVQDTERRFAQGSSLSFAAVDRLQDSGTFQCVARDDVTGEEARSANASFN IKWIEAGPVVLKHPASEAEIQPQTQVTLRCHIDGHPRPTYQWFRDGTPLSDGQSNHTVSSK ERNLTLRPAGPEHSGLYSCCAHSAFGQACSSQNFTLSIADESFARVVLAPQDVVVARYEE AMFHCQFSAQPPPSLQWLFEDETPITNRSRPPHLRRATVFANGSLLLTQVRPRNAGIYRCI GQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYR CMSSTPAGSEEAQARVQVLEKLKFTPPPQPQQCMEFDKEATVPCSATGREKPTIKWERAD GSSLPEWVTDNAGTLHFARVTRDDAGNYTCIASNGPQGQIRAHVQLTVAVFITFKVEPER TTVYQGHTALLQCEAQGDPKPLIQWK corresponding to amino acids 1-626 of NP_690621 (SEQ ID NO:410), which also corresponds to amino acids 1-626 of T51958_P1 (SEQ ID NO:423), and a second amino acid sequence being at least 70%, optionally at least 80%, preferably at least 85%, more preferably at least 90% and most preferably at least 95% homologous to a polypeptide having the sequence GKDRILDPTKLGPRMHIFQNGSLVIHDVAPEDSGRYTCIAGNSCNIKHTEAPLYVVGMGW GGLCCTGSGGPRRLSPCTQPLCTEHGTEAIFVAAVGIRPSHHAAAQS (SEQ ID NO:620) corresponding to amino acids 627-733 of T51958_P1 (SEQ ID NO:423), wherein said first amino acid sequence and second amino acid sequence are contiguous and in a sequential order.

B. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GKDRILDPTKLGPRMHIFQNGSLVIHD-VAPEDSGRYTCIAGNSCNIKHTEAPLYVVGMGW GGLCCTGSGGPRRLSPCTQPLCTEH-GTEAIFVAAVGIRPSHHAAAQS (SEQ ID NO:620) of T51958_P1 (SEQ ID NO:423).

10. Comparison Report Between T51958_P1 (SEQ ID NO:423) and Q8NFA7_HUMAN (SEQ ID NO:421):

A. An isolated chimeric polypeptide encoding for T51958_P1 (SEQ ID NO:423), comprising a first amino acid (sequence being at least 90% homologous to MGAARG-SPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of Q8NFA7_HUMAN (SEQ ID NO:421), which also corresponds to amino acids 1-409 of T51958_P1 (SEQ ID NO:423), a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD (SEQ ID NO:621) corresponding to amino acids 410-540 of T51958_P1 (SEQ ID NO:423), a third amino acid sequence being at least 90% homologous to GSSLPEWVTDNAGTL-HFARVTRDDAGNYTCIASNGPQGQIRAHVQLTVAV-FITFKVEPER TTVYQGHTALLQCEAQGDPKPLI-QWKGKDRILDPTKLGPRMHIFQNGSLVIHDVAPEDSG RYTCIAGNSCNIKHTEAPLYVV corresponding to amino acids 411-552 of Q8NFA7_HUMAN (SEQ ID NO:421), which also corresponds to amino acids 541-682 of T51958_P1 (SEQ ID NO:423), and a fourth amino acid sequence being at least 70%, optionally at least 80%, preferably at least 85%, more preferably at least 90% and most preferably at least 95% homologous to a polypeptide having the sequence GMGWGGLCCTGSGGPRRLSPCTQ-PLCTEHGTEAIFVAAVGIRPSHHAAAQS (SEQ ID NO:618) corresponding to amino acids 683-733 of T51958_P1 (SEQ ID NO:423), wherein said first amino acid sequence, second amino acid sequence, third amino acid sequence and fourth amino acid sequence are contiguous and in a sequential order.

B. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLD-CLTQATPKPTVVWYRNQMLISEDSRFEVFKNGTLRIN SVEVYDGTWYRCMSSTPAGSEE-AQARVQVLEKLKFTPPPQPQQCMEFD-KEATVPCSATG REKPTIKWERAD (SEQ ID NO:621) of T51958_P1 (SEQ ID NO:423).

C. A bridge portion of T51958_P1 (SEQ ID NO:423), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AT, having a structure as follows (numbering according to T51958_P1): a sequence starting from any of amino acid numbers 409-x to 409; and ending at any of amino acid numbers 410+((n-2)−x), in which x varies from 0 to n-2.

A bridge portion of T51958_P1 (SEQ ID NO:423), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DG, having a structure as follows (numbering according to T51958_P1): a sequence starting from any of amino acid numbers 540-x to 540; and ending at any of amino acid numbers 541+((n-2)−x), in which x varies from 0 to n-2.

D. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQ-PLCTEHGTEAIFVAAVGIRPSHHAAAQS (SEQ ID NO:618) of T51958_P1 (SEQ ID NO:423).

11. Comparison Report Between T51958_P1 (SEQ ID NO:423) and NP_690620 (SEQ ID NO:411):

A. An isolated chimeric polypeptide encoding for T51958_P1 (SEQ ID NO:423), comprising a first amino acid sequence being at least 90% homologous to MGAARG-SPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of NP_690620 (SEQ ID NO:411), which also corresponds to amino acids 1-409 of T51958_P1 (SEQ ID NO:423), a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD (SEQ ID NO:621) corresponding to amino acids 410-540 of T51958_P1 (SEQ ID NO:423), a third amino acid sequence being at least 90% homologous to GSSLPEWVTDNAGTL-HFARVTRDDAGNYTCIASNGPQGQIAH- VQLTVAVFITFKVEPER TTVYQGHTALLQCEAQGDPKPLIQWKGKDRILDPTKLGPRMHIFQNGSLVIHDVAPEDSG RYTCIAGNSCNIKHTEAPLYVV corresponding to amino acids 411-552 of NP_690620 (SEQ ID NO:411), which also corresponds to amino acids 541-682 of T51958_P1 (SEQ ID NO:423), and a fourth amino acid sequence being at least 70%, optionally at least 80%, preferably at least 85%, more preferably at least 90% and most preferably at least 95% homologous to a polypeptide having the sequence GMGWGGLCCTGSGGPRRLSPCTQPLCTEHGTEAIFVAAVGIRPSHHAAAQS (SEQ ID NO:618) corresponding to amino acids 683-733 of T51958_P1 (SEQ ID NO:423), wherein said first amino acid sequence, second amino acid sequence, third amino acid sequence and fourth amino acid sequence are contiguous and in a sequential order.

B. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATG REKPTIKWERAD (SEQ ID NO:621) of T51958_P1 (SEQ ID NO:423).

C. A bridge portion of T51958_P1 (SEQ ID NO:423), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AT, having a structure as follows (numbering according to T51958_P1): a sequence starting from any of amino acid numbers 409-x to 409; and ending at any of amino acid numbers 410+((n-2)-x), in which x varies from 0 to n-2.

A bridge portion of T51958_P1 (SEQ ID NO:423), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DG, having a structure as follows (numbering according to T51958_P1): a sequence starting from any of amino acid numbers 540-x to 540; and ending at any of amino acid numbers 541+((n-2)-x), in which x varies from 0 to n-2.

D. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence GMGWGGLCCTGSGGPRRLSPCTQPLCTEHGTEAIFVAAVGIRPSHHAAAQS (SEQ ID NO:618) of T51958_P1 (SEQ ID NO:423).

12. Comparison Report Between T51958_P1 (SEQ ID NO:423) and Q86X91_HUMAN (SEQ ID NO:422):

A. An isolated chimeric polypeptide encoding for T51958_P1 (SEQ ID NO:423), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEEEDMPLFEPRVFTAGSEERVTCLPPKGLPEPSVWWEHAGVRL PTHGRVYQKGHELVLANIAESDAGVYTCHAANLAGQRRQDVNITVA corresponding to amino acids 1-409 of Q86X91_HUMAN (SEQ ID NO:422), which also corresponds to amino acids 1-409 of T51958_P1 (SEQ ID NO:423), and a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLDCLTQATPKPTVVWYRNQMLISEDSRFEVFKNGTLRIN SVEVYDGTWYRCMSSTPAGSEEAQARVQVLEKLKFTPPPQPQQCMEFDKEATVPCSATG REKPTIKWERADGSSLPEWVTDNAGTLHFARVTRDDAGNYTCIASNGPQGQIRAHVQLT VAVFITFKVEPERTTVYQGHTALLQCEAQGDPKPLIQWKGKDRILDPTKLGPRMHIFQNG SLVIHDVAPEDSGRYTCIAGNSCNIKHTEAPLYVVGMGWGGLCCTGSGGPRRLSPCTQPL CTEHGTEAIFVAAVGIRPSHHAAAQS (SEQ ID NO:622) corresponding to amino acids 410-733 of T51958_P1 (SEQ ID NO:423), wherein said first amino acid sequence and second amino acid sequence are contiguous and in a sequential order.

B. An isolated polypeptide encoding for an edge portion of T51958_P1 (SEQ ID NO:423), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLDCLTQATPKPTVVWYRNQMLISEDSRFEVFKNGTLRIN SVEVYDGTWYRCMSSTPAGSIEAQARVQVLEKLKFTPPPQPQQCMEFDKEATVPCSATG REKPTIKWERADGSSLPEWVTDNAGTLHFARVTRDDAGNYTCIASNGPQGQWAAHVQLT VAVFITFKVEPERTTVYQGHTALLQCEAQGDPKPLIQWKGKDRILDPTKLGPRMHIFQNG SLVIHDVAPEDSGRYTCIAGNSCNIKHTEAPLYVVGMGWGGLCCTGSGGPRRLSPCTQPL CTEHGTEAIFVAAVGIRPSHHAAAQS (SEQ ID NO:622) of T51958_P1 (SEQ ID NO:423).

The localization of the variant protein was determined according to results from a number of different software programs and analyses, including analyses from SignalP and other specialized programs. The variant protein is believed to be located as follows with regard to the cell: secreted.

Variant protein T51958_P1 (SEQ ID NO:423) also has the following non-silent SNPs (Single Nucleotide Polymorphisms) as listed in Table 429, (given according to their position(s) on the amino acid sequence, with the alternative amino acid(s) listed; the last column indicates whether the SNP is known or not; the presence of known SNPs in variant protein T51958_P1 (SEQ ID NO:423) sequence provides support for the deduced sequence of this variant protein according to the present invention).

TABLE 429

| Amino acid mutations | | |
|---|---|---|
| SNP position(s) on amino acid sequence | Alternative amino acid(s) | Previously known SNP? |
| 207 | G -> D | Yes |
| 689 | L -> V | Yes |

The glycosylation sites of variant protein T51958_P1 (SEQ ID NO:423), as compared to the known protein Tyrosine-protein kinase-like 7 precursor (SEQ ID NO:409), are described in Table 430 (given according to their position(s) on the amino acid sequence in the first column; the second column indicates whether the glycosylation site is present in the variant protein; and the last column indicates whether the position is different on the variant protein).

TABLE 430

| Glycosylation site(s) | | |
|---|---|---|
| Position(s) on known amino acid sequence | Present in variant protein? | Position(s) on variant protein |
| 116 | Yes | 116 |
| 175 | Yes | 175 |
| 184 | Yes | 184 |
| 214 | Yes | 214 |
| 268 | Yes | 268 |
| 283 | Yes | 283 |
| 405 | Yes | 405 |
| 463 | Yes | 463 |
| 567 | Yes | 567 |
| 646 | Yes | 646 |

Variant protein T51958_P1 (SEQ ID NO:423) is encoded by the following transcript(s): T51958_T1 (SEQ ID NO:350), T51958_T10 (SEQ ID NO:354), T51958_T12 (SEQ ID NO:355) and T51958_T31 (SEQ ID NO:358), for which the sequence(s) is/are given at the end of the application.

The coding portion of transcript T51958_T1 (SEQ ID NO:350) is shown in bold; this coding portion starts at position 222 and ends at position 2420. The transcript also has the following SNPs as listed in Table 431 (given according to their position on the nucleotide sequence, with the alternative nucleic acid listed; the last column indicates whether the SNP is known or not; the presence of known SNPs in variant protein T51958_P1 (SEQ ID NO:423) sequence provides support for the deduced sequence of this variant protein according to the present invention).

TABLE 431

| Nucleic acid SNPs | | |
|---|---|---|
| SNP position(s) on nucleotide sequence | Alternative nucleic acid(s) | Previously known SNP? |
| 841 | G -> A | Yes |
| 2072 | G -> A | Yes |
| 2286 | T -> G | Yes |
| 4651 | C -> | No |
| 4784 | T -> C | No |

The coding portion of transcript T51958_T10 (SEQ ID NO:354) is shown in bold; this coding portion starts at position 222 and ends at position 2420. The transcript also has the following SNPs as listed in Table 432 (given according to their position on the nucleotide sequence, with the alternative nucleic acid listed; the last column indicates whether the SNP is known or not; the presence of known SNPs in variant protein T51958_P1 (SEQ ID NO:423) sequence provides support for the deduced sequence of this variant protein according to the present invention).

TABLE 432

| Nucleic acid SNPs | | |
|---|---|---|
| SNP position(s) on nucleotide sequence | Alternative nucleic acid(s) | Previously known SNP? |
| 841 | G -> A | Yes |
| 2072 | G -> A | Yes |
| 2286 | T -> G | Yes |
| 4653 | C -> | No |
| 4786 | T -> C | No |

The coding portion of transcript T51958_T12 (SEQ ID NO:355) is shown in bold; this coding portion starts at position 222 and ends at position 2420. The transcript also has the following SNPs as listed in Table 433 (given according to their position on the nucleotide sequence, with the alternative nucleic acid listed; the last column indicates whether the SNP is known or not; the presence of known SNPs in variant protein T51958_P1 (SEQ ID NO:423) sequence provides support for the deduced sequence of this variant protein according to the present invention).

TABLE 433

| Nucleic acid SNPs | | |
|---|---|---|
| SNP position(s) on nucleotide sequence | Alternative nucleic acid(s) | Previously known SNP? |
| 841 | G -> A | Yes |
| 2072 | G -> A | Yes |
| 2286 | T -> G | Yes |
| 5481 | C -> | No |
| 5614 | T -> C | No |

The coding portion of transcript T51958_T31 (SEQ ID NO:358) is shown in bold; this coding portion starts at position 222 and ends at position 2420. The transcript also has the following SNPs as listed in Table 434 (given according to their position on the nucleotide sequence, with the alternative nucleic acid listed; the last column indicates whether the SNP is known or not; the presence of known SNPs in variant protein T51958_P1 (SEQ ID NO:423) sequence provides support for the deduced sequence of this variant protein according to the present invention).

TABLE 434

| Nucleic acid SNPs | | |
|---|---|---|
| SNP position(s) on nucleotide sequence | Alternative nucleic acid(s) | Previously known SNP? |
| 841 | G -> A | Yes |
| 2072 | G -> A | Yes |
| 2286 | T -> G | Yes |
| 3783 | C -> T | No |

Variant protein T51958_P8 (SEQ ID NO:424) according to the present invention has an amino acid sequence as given at the end of the application; it is encoded by transcript(s) T51958_T8 (SEQ ID NO:353). An alignment is given to the known protein (Tyrosine-protein kinase-like 7 precursor (SEQ ID NO:409)) at the end of the application. One or more alignments to one or more previously published protein sequences are given at the end of the application. A brief description of the relationship of the variant protein according to the present invention to each such aligned protein is as follows:

1. Comparison Report Between T51958_P8 (SEQ ID NO:424) and PTK7_HUMAN (SEQ ID NO:595):

A. An isolated chimeric polypeptide encoding for T51958_P8 (SEQ ID NO:424), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVD corresponding to amino acids 1-91 of PTK7_HUMAN (SEQ ID NO:595), which also corresponds to amino acids 1-91 of T51958_P8 (SEQ ID NO:424), a bridging amino acid R corresponding to amino acid 92 of T51958_P8 (SEQ ID NO:424), a second amino acid sequence being at least 90% homologous to LQDSGTFQCVARDDVTGEEARSANASFNIKWIEAGPVVLKBPASEAEIQPQTQV corresponding to amino acids 93-146 of PTK7_HUMAN (SEQ ID NO:595), which also corresponds to amino acids 93-146 of T51958_P8 (SEQ ID NO:424), a bridging amino acid T corresponding to amino acid 147 of T51958_P8 (SEQ ID NO:424), a third amino acid sequence being at least 90% homologous to LRCHIDGHPRPTYQWFRDGTPLSDGQSNHTVSSKERNLTLRPAGPEHSGLYSCCAHSAF corresponding to amino acids 148-206 of PTK7_HUMAN (SEQ ID NO:595), which also corresponds to amino acids 148-206 of T51958_P8 (SEQ ID NO:424), a bridging amino acid G corresponding to amino acid 207 of T51958_P8 (SEQ ID NO:424), a fourth amino acid sequence being at least 90% homologous to QACSSQNFTLSIADESFARVVLAPQDVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYR NQMLISEDSRFEVFKNGTLRINSVEVYDGTWYRCMSSTPAGSIEAQA corresponding to amino acids 208-494 of PTK7_HUMAN (SEQ ID NO:595), which also corresponds to amino acids 208-494 of T51958_P8 (SEQ ID NO:424), bridging amino acids RV corresponding to amino acid 495-496 of T51958_P8 (SEQ ID NO:424), a fifth amino acid sequence being at least 90% homologous to QVLEKLKFTPPPQPQQCM corresponding to amino acids 497-514 of PTK7_HUMAN (SEQ ID NO:595), which also corresponds to amino acids 497-514 of T51958_P8 (SEQ ID NO:424), a bridging amino acid E corresponding to amino acid 515 of T51958_P8 (SEQ ID NO:424), a sixth amino acid sequence being at least 90% homologous to FDKEATVPCSATGREKPTIKWERADGSSLPEWVTDNAGTLHFARVTRDDAGNYTCIASN GPQGQIRAHVQLTVAVFITFKVEPERTTVYQGHTALLQCEAQGDPKPLIQWKGKDRILDP TKLGPRM corresponding to amino acids 516-641 of PTK7_HUMAN (SEQ ID NO:595), which also corresponds to amino acids 516-641 of T51958_P8 (SEQ ID NO:424), and a seventh amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence, bridging amino acid, second amino acid sequence, bridging amino acid, third amino acid sequence, bridging amino acid, fourth amino acid sequence, bridging amino acid, fifth amino acid sequence, bridging amino acid, sixth amino acid sequence and seventh amino acid sequence are contiguous and in a sequential order.

B. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

2. Comparison Report Between T51958_P8 (SEQ ID NO:424) and NP_690622 (SEQ ID NO:414):

A. An isolated chimeric polypeptide encoding for T51958_P8 (SEQ ID NO:424), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERAD GSSLPEWVTDNAGTLHFARVTRDDAGNYTCIASNGPQGQIRAHVQLTVAVFITFKVEPER TTVYQGHTALLQCEAQGDPKPLIQWKGKDRILDPTKLGPRM corresponding to amino acids 1-641 of NP_690622 (SEQ ID NO:414), which also corresponds to amino acids 1-641 of T51958_P8 (SEQ ID NO:424), and a second amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence and second amino acid sequence are contiguous and in a sequential order.

B. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

3. Comparison Report Between T51958_P8 (SEQ ID NO:424) and Q8NFA5_HUMAN (SEQ ID NO:420):

A. An isolated chimeric polypeptide encoding for T51958_P8 (SEQ ID NO:424), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLS- FAAVDRLQDSGTFQCVARDDVTGEEARSANASFN IKWIEAGPVVLKHPASEAEIQPQTQVTL- RCHIDGHPRPTYQWFRDGTPLSDGQSNHTVSSK ERNLTLRPAGPEHSGLYSCCAHSAF- GQACSSQNFTLSIADESFARVVLAPQDVVVARYEE AMFHCQFSAQPPPSLQWLFEDETPIT- NRSRPPHLRRATVFANGSLLLTQVRPRNAGIYRCI GQGQRGPPIILEATLHLAEIEDM- PLFEPRVFTAGSEERVTCLPPKGLPEPS- VWWEHAGVRL PTHGRVYQKGHELVLANIAES- DAGVYTCHAANLAGQRRQDVNITVATVPSWLKKP- QDS QLEEGKPGYLDCLTQATPKPTVVWYRN- QMLISEDSRFEVFKNGTLRINSVEVYDGTWYR CMSSTPAGSIEAQARVQVLEKLKFTPP- PQPQQCMEFDKEATVPCSATGREKPTIKWERAD GSS- LPEWVTDNAGTLHFARVTRDDAGNYT- CIASNGPQGQIRAHVQLTVAVFITFKVEPER TTVYQGHTALLQCEAQGDPKPLI- QWKGKDRILDPTKLGPRM corresponding to amino acids 1-641 of Q8NFA5_HUMAN (SEQ ID NO:420), which also corresponds to amino acids 1-641 of T51958_P8 (SEQ ID NO:424), and a second amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence and second amino acid sequence are contiguous and in a sequential order.

B. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

4. Comparison Report Between T51958_P8 (SEQ ID NO:424) and NP_002812 (SEQ ID NO:413):

A. An isolated chimeric polypeptide encoding for T51958_P8 (SEQ ID NO:424), comprising a first amino acid sequence being at least 90% homologous to MGAARG- SPARPRRLPLLSVLLLPLLG- GTQTAIVFIKQPSSQDALQGRRALLRCEVEAPGPV HVYWLLDGAPVQDTERRFAQGSSLS- FAAVDRLQDSGTFQCVARDDVTGEEARSANASFN IKWIEAGPVVLKHPASEAEIQPQTQVTL- RCHIDGHPRPTYQWFRDGTPLSDGQSNHTVSSK ERNLTLRPAGPEHSGLYSCCAHSAF- GQACSSQNFTLSIADESFARVVLAPQDVVVARYEE AMFHCQFSAQPPPSLQWLFEDETPIT- NRSRPPHLRRATVFANGSLLLTQVRPRNAGIYRCI GQGQRGPPIILEATLHLAEEEDM- PLFEPRVFTAGSEERVTCLPPKGLPEPS- VWWEHAGVRL PTHGRVYQKGHELVLANIAES- DAGVYTCHAANLAGQRRQDVNITVATVPSWLKKP- QDS QLEEGKPGYLDCLTQATPKPTVVWYRN- QMLISEDSRFEVFKNGTLRINSVEVYDGTWYR CMSSTPAGSEAQARVQVLEKLKFTPP- PQPQQCMEFDKEATVPCSATGREKPTIKWERAD GSS- LPEWVTDNAGTLHFARVTRDDAGNYT- CIASNGPQGQIRAHVQLTVAVFITFKVEPER TTVYQGHTALLQCEAQGDPKPLI- QWKGKDRILDPTKLGPRM corresponding to amino acids 1-641 of NP_002812 (SEQ ID NO:413), which also corresponds to amino acids 1-641 of T51958_P8 (SEQ ID NO:424), and a second amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence and second amino acid sequence are contiguous and in a sequential order.

B. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

5. Comparison Report Between T51958_P8 (SEQ ID NO:424) and Q6IQ54_HUMAN (SEQ ID NO:419):

A. An isolated chimeric polypeptide encoding for T51958_P8 (SEQ ID NO:424), comprising a first amino acid sequence being at least 90% homologous to MGAARG- SPARPRRLPLLSVLLLPLLG- GTQTAIVFIKQPSSQDALQGRRALLRCEVEAPGPV HVYWLLDGAPVQDTERRFAQGSSLSFAAVDR corresponding to amino acids 1-92 of Q6IQ54_HUMAN (SEQ ID NO:419), which also corresponds to amino acids 1-92 of T51958_P8 (SEQ ID NO:424), a bridging amino acid L corresponding to amino acid 93 of T51958_P8 (SEQ ID NO:424), a second amino acid sequence being at least 90% homologous to QDSGTFQCVARDDVTGEEARSANAS- FNIKWIEAGPVVLKHPASEAEIQPQTQVTLRCHID GHPRPTYQWFRDGTPLSDGQS- NHTVSSKERNLTLRPAGPEHSGLY- SCCAHSAFGQACSSQ NFTLSIADESFARVVLAPQDV- VVARYEEAMFHCQFSAQPPPSLQWLFEDETPITNRS- RPPH LRRATVFANGSLLLTQVRPRNAGIYR- CIGQGQRGPPIILEATLHLAEIEDMPLFEPRVFTAG SEERVTCLPPKGLPEPSVWWEHAGVR- LPTHGRVYQKGHELVLANIAESDAGVYTCHAAN LAGQRRQDVNITVATVPSWLKKPQD- SQLEEGKPGYLDCLTQATPKPTVVWYRNQMLISE DSRFEVFKNGTLRINSVEVYDGTWYRC- MSSTPAGSIEAQARVQVLEKLKFTPPPQPQQCM EFD- KEATVPCSATGREKPTIKWERADGSS- LPEWVTDNAGTLHFARVTRDDAGNYTCIASN GPQGQIRAHVQLTVAVFITFKVEPERT- TVYQGHTALLQCEAQGDPKPLIQWKGKDRILDP TKLGPRM corresponding to amino acids 94-641 of Q6IQ54_HUMAN (SEQ ID NO:419), which also corresponds to amino acids 94-641 of T51958_P8 (SEQ ID NO:424), and a third amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence, bridging amino acid, second amino acid sequence and third amino acid sequence are contiguous and in a sequential order.

B. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

6. Comparison Report Between T51958_P8 (SEQ ID NO:424) and NP_690621 (SEQ ID NO:410):

A. An isolated chimeric polypeptide encoding for T51958_P8 (SEQ ID NO:424), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYR CMSSTPAGSIEAQARVQVLEKLKFTPPPQPQQCMEFDKEATVPCSATGREKPTIKWERAD GSSLPEWVTDNAGTLHFARVTRDDAGNYTCIASNGPQGQIRAHVQLTVAVFITFKVEPER TTVYQGHTALLQCEAQGDPKPLIQWK corresponding to amino acids 1-626 of NP_690621 (SEQ ID NO:410), which also corresponds to amino acids 1-626 of T51958_P8 (SEQ ID NO:424), and a second amino acid sequence being at least 70%, optionally at least 80%, preferably at least 85%, more preferably at least 90% and most preferably at least 95% homologous to a polypeptide having the sequence GKDRILDPTKLGPRMAPW (SEQ ID NO:624) corresponding to amino acids 627-644 of T51958_P8 (SEQ ID NO:424), wherein said first amino acid sequence and second amino acid sequence are contiguous and in a sequential order.

B. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence GKDRILDPTKLGPRMAPW (SEQ ID NO:624) of T51958_P8 (SEQ ID NO:424).

7. Comparison Report Between T51958_P8 (SEQ ID NO:424) and Q8NFA6_HUMAN (SEQ ID NO:418):

A. An isolated chimeric polypeptide encoding for T51958_P8 (SEQ ID NO:424), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYR CMSSTPAGSIEAQARVQVLEKLKFTPPPQPQQCMEFDKEATVPCSATGREKPTIKWERAD GSSLPEWVTDNAGTLHFARVTRDDAGNYTCIASNGPQGQIRAHVQLTVAVFITFKVEPER TTVYQGHTALLQCEAQGDPKPLIQWK corresponding to amino acids 1-626 of Q8NFA6_HUMAN (SEQ ID NO:418), which also corresponds to amino acids 1-626 of T51958_P8 (SEQ ID NO:424), and a second amino acid sequence being at least 70%, optionally at least 80%, preferably at least 85%, more preferably at least 90% and most preferably at least 95% homologous to a polypeptide having the sequence GKDRILDPTKLGPRMAPW (SEQ ID NO:624) corresponding to amino acids 627-644 of T51958_P8 (SEQ ID NO:424), wherein said first amino acid sequence and second amino acid sequence are contiguous and in a sequential order.

B. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence GKDRILDPTKLGPRMAPW (SEQ ID NO:624) of T51958_P8 (SEQ ID NO:424).

8. Comparison Report Between T51958_P8 (SEQ ID NO:424) and NP_690619 (SEQ ID NO:412):

A. An isolated chimeric polypeptide encoding for T51958_P8 (SEQ ID NO:424), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYR CMSSTPAGSIEAQARVQVL corresponding to amino acids 1-499 of NP_690619 (SEQ ID NO:412), which also corresponds to amino acids 1-499 of T51958_P8 (SEQ ID NO:424), a second amino acid sequence being at least 70%, optionally at least 80%, preferably at least 85%, more preferably at least 90% and most preferably at least 95% homologous to a polypeptide having the sequence EKLKFTPPPQPQQCMEFDKEATVPCSATGREKPTIKWERA (SEQ ID NO:619) corresponding to amino acids 500-539 of T51958_P8 (SEQ ID NO:424), a third amino acid sequence being at least 90% homologous to DGSSLPEWVTDNAGTLHFARVTRDDAGNYTCIASNGPQGQIRAHVQLTVAVFITFKVEPE RTTVYQGHTALLQCEAQGDPKPLIQWKGKDRILDPTKLGPRM corresponding to amino acids 500-601 of NP_690619 (SEQ ID NO:412), which also corresponds to amino acids 540-641 of T51958_P8 (SEQ ID NO:424), and a fourth amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence, second amino acid sequence, third amino acid sequence and fourth amino acid sequence are contiguous and in a sequential order.

B. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence EKLKFTPPPQPQQCMEFDKEATVPCSAT-GREKPTIKWERA (SEQ ID NO:619) of T51958_P8 (SEQ ID NO:424).

C. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

9. Comparison Report Between T51958_P8 (SEQ ID NO:424) and Q8NFA8_HUMAN (SEQ ID NO:416):

A. An isolated chimeric polypeptide encoding for T51958_P8 (SEQ ID NO:424), comprising a first amino acid sequence being at least 90% homologous to MGAARG-SPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVATVPSWLKKP-QDS QLEEGKPGYLDCLTQATPKPTVVWYRN-QMLISEDSRFEVFKNGTLRINSVEVYDGTWYR CMSSTPAGSIEAQARVQVL corresponding to amino acids 1-499 of Q8NFA8_HUMAN (SEQ ID NO:416), which also corresponds to amino acids 1-499 of T51958_P8 (SEQ ID NO:424), a second amino acid sequence being at least 70%, optionally at least 80%, preferably at least 85%, more preferably at least 90% and most preferably at least 95% homologous to a polypeptide having the sequence EKLKFTPP-PQPQQCMEFDKEATVPCSATGREKPTIKWERA (SEQ ID NO:619) corresponding to amino acids 500-539 of T51958_P8 (SEQ ID NO:424), a third amino acid sequence being at least 90% homologous to DGSSLPEWVTD-NAGTLHFARVTRDDAGNYTCIASNGPQG-QIRAHVQLTVAVFITFKVEPE RTTVYQGHTALLQCEAQGDPKPLI-QWKGKDRILDPTKLGPRM corresponding to amino acids 500-601 of Q8NFA8_HUMAN (SEQ ID NO:416), which also corresponds to amino acids 540-641 of T51958_P8 (SEQ ID NO:424), and a fourth amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence, second amino acid sequence, third amino acid sequence and fourth amino acid sequence are contiguous and in a sequential order.

B. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence EKLKFTPPPQPQQCMEFDKEATVPCSAT-GREKPTIKWERA (SEQ ID NO:619) of T51958_P8 (SEQ ID NO:424).

C. An isolated polypeptide encoding for an edge portion of T51958_P8 (SEQ ID NO:424), comprising an amino acid sequence being at least 70%, optionally at least about 80%, preferably at 10 least about 85%, more preferably at least about 90% and most preferably at least about 95% homologous to the sequence APW (SEQ ID NO:623) of T51958_P8 (SEQ ID NO:424).

10. Comparison Report Between T51958_P8 (SEQ ID NO:424) and NP_690620 (SEQ ID NO:411):

A. An isolated chimeric polypeptide encoding for T51958_P8 (SEQ ID NO:424), comprising a first amino acid sequence being at least 90% homologous to MGAARG-SPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of NP_690620 (SEQ ID NO:411), which also corresponds to amino acids 1-409 of T51958_P8 (SEQ ID NO:424), a second amino acid sequence being at least 70%, optionally at least 80%, preferably at least 85%, more preferably at least 90% and most preferably at least 95% homologous to a polypeptide having the sequence TVPSWLKKPQDSLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD (SEQ ID NO:621) corresponding to amino acids 410-540 of T51958_P8 (SEQ ID NO:424), a third amino acid sequence being at least 90% homologous to GSSLPEWVTDNAGTL-HFARVTRDDAGNYTCIASNGPQGQIRAH-VQLTVAVFITFKVEPER TTVYQGHTALLQCEAQGDP-KPLIQWKGKDRILDPTKLGPRM corresponding to amino acids 411-511 of NP_690620 (SEQ ID NO:411), which also corresponds to amino acids 541-641 of T51958_P8 (SEQ ID NO:424), and a fourth amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ iID NO:424), wherein said first amino acid sequence, second amino acid sequence, third amino acid sequence and fourth amino acid sequence are contiguous and in a sequential order.

B. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD (SEQ ID NO:621) of T51958_P8 (SEQ ID NO:424).

C. A bridge portion of T51958_P8 (SEQ ID NO:424), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AT, having a structure as follows (numbering according to T51958_P8): a sequence starting from any of amino acid numbers 409-x to 409; and ending at any of amino acid numbers 410+((n-2)−x), in which x varies from 0 to n-2.

A bridge portion of T51958_P8 (SEQ ID NO:424), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DG, having a structure as follows (numbering according to T51958_P8): a sequence starting from any of amino acid numbers 540-x to 540; and ending at any of amino acid numbers 541+((n-2)−x), in which x varies from 0 to n-2.

D. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

11. Comparison Report Between T51958_P8 (SEQ ID NO:424) and Q8NFA7_HUMAN (SEQ ID NO:421):

A. An isolated chimeric polypeptide encoding for T51958_P8 (SEQ ID NO:424), comprising a first amino acid sequence being at least 90% homologous to MGAARG-SPARPRRLPLLSVLLLPLLG-GTQTAfVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of Q8NFA7_HUMAN (SEQ ID NO:421), which also corresponds to amino acids 1-409 of T51958_P8 (SEQ ID NO:424), a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD (SEQ ID NO:621) corresponding to amino acids 410-540 of T51958_P8 (SEQ ID NO:424), a third amino acid sequence being at least 90% homologous to GSSLPEWVTDNAGTL-HFARVTRDDAGNYTCIASNGPQGQIRAH-VQLTVAVFITFKVEPER TTVYQGHTALLQCEAQGDP-KPLIQWKGKDRILDPTKLGPRM corresponding to amino acids 411-511 of Q8NFA7_HUMAN (SEQ ID NO:421), which also corresponds to amino acids 541-641 of T51958_P8 (SEQ ID NO:424), and a fourth amino acid sequence being at least 70%, optionally at least 80%, preferably at least 85%, more preferably at least 90% and most preferably at least 95% homologous to a polypeptide having the sequence APW (SEQ ID NO:623) corresponding to amino acids 642-644 of T51958_P8 (SEQ ID NO:424), wherein said first amino acid sequence, second amino acid sequence, third amino acid sequence and fourth amino acid sequence are contiguous and in a sequential order.

B. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD (SEQ ID NO:621) of T51958_P8 (SEQ ID NO:424).

C. A bridge portion of T51958_P8 (SEQ ID NO:424), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AT, having a structure as follows (numbering according to T51958_P8): a sequence starting from any of amino acid numbers 409-x to 409; and ending at any of amino acid numbers 410+((n-2)−x), in which x varies from 0 to n-2.

A bridge portion of T51958_P8 (SEQ ID NO:424), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DG, having a structure as follows (numbering according to T51958_P8): a sequence starting from any of amino acid numbers 540-x to 540; and ending at any of amino acid numbers 541+((n-2)−x), in which x varies from 0 to n-2.

D. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence APW (SEQ ID NO:623) of T51958_P8 (SEQ ID NO:424).

12. Comparison Report Between T51958_P8 (SEQ ID NO:424) and Q86X91_HUMAN (SEQ ID NO:422):

A. An isolated chimeric polypeptide encoding for T51958_P8 (SEQ ID NO:424), comprising a first amino acid sequence being at least 90% homologous to MGAARG-SPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-
RCHIDGHPRPTYQWFRDGTPLSDGQSNHTVSSK
ERNLTLRPAGPEHSGLYSCCAHSAF-
GQACSSQNFTLSIADESFARVVLAPQDVVVARYEE
AMFHCQFSAQPPPSLQWLFEDETPIT-
NRSRPPHLRRATVFANGSLLLTQVRPRNAGIYRCI
GQGQRGPPIILEATLHLAEIEDM-
PLFEPRVFTAGSEERVTCLPPKGLPEPS-
VWWEHAGVRL PTHGRVYQKGHELVLANIAES-
DAGVYTCHAANLAGQRRQDVNITVA corresponding to amino acids 1-409 of Q86X91_HUMAN (SEQ ID NO:422), which also corresponds to amino acids 1-409 of T51958_P8 (SEQ ID NO:424), and a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLD-
CLTQATPKPTVVWYRNQMLISEDSRFEVFKNGTLRIN
SVEVYDGTWYRCMSSTPAG-
SIEAQARVQVLEKLKFTPPPQPQQC-
MEFDKEATVPCSATG REKPTIKWERADGSS-
LPEWVTDNAGTLHFARVTRDDAGNYTCIASNGPQG-
QIAHVQLT VAVFITFKVEPERT-
TVYQGHTALLQCEAQGDPKPLI-
QWKGKDRILDPTKLGPRMAPW (SEQ ID NO:627) corresponding to amino acids 410-644 of T51958_P8 (SEQ ID NO:424), wherein said first amino acid sequence and second amino acid sequence are contiguous and in a sequential order.

B. An isolated polypeptide encoding for an edge portion of T51958_P8 (SEQ ID NO:424), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLD-
CLTQATPKPTVVWYRNQMLISEDSRFEVFKNGTLRIN
SVEVYDGTWYRCMSSTPAG-
SIEAQARVQVLEKLKFTPPPQPQQC-
MEFDKEATVPCSATG REKPTIKWERADGSS-
LPEWVTDNAGTLHFARVTRDDAGNYTCIASNGPQG-
QIRAHVQLT VAVFITFKVEPERT-
TVYQGHTALLQCEAQGDPKPLI-
QWKGKDRILDPTKLGPRMAPW (SEQ ID NO:627) of T51958_P8 (SEQ ID NO:424).

The localization of the variant protein was determined according to results from a number of different software programs and analyses, including analyses from SignalP and other specialized programs. The variant protein is believed to be located as follows with regard to the cell: secreted.

Variant protein T51958_P8 (SEQ ID NO:424) also has the following non-silent SNPs (Single Nucleotide Polymorphisms) as listed in Table 435, (given according to their position(s) on the amino acid sequence, with the alternative amino acid(s) listed; the last column indicates whether the SNP is known or not; the presence of known SNPs in variant protein T51958_P8 (SEQ ID NO:424) sequence provides support for the deduced sequence of this variant protein according to the present invention).

TABLE 435

Amino acid mutations

| SNP position(s) on amino acid sequence | Alternative nucleic acid(s) | Previously known SNP? |
|---|---|---|
| 207 | G -> D | Yes |

The glycosylation sites of variant protein T51958_P8 (SEQ ID NO:424), as compared to the known protein Tyrosine-protein kinase-like 7 precursor (SEQ ID NO:409), are described in Table 436 (given according to their position(s) on the amino acid sequence in the first column; the second column indicates whether the glycosylation site is present in the variant protein; and the last column indicates whether the position is different on the variant protein).

TABLE 436

Glycosylation site(s)

| Position(s) on known amino acid sequence | Present in variant protein? | Position(s) on variant protein |
|---|---|---|
| 116 | Yes | 116 |
| 175 | Yes | 175 |
| 184 | Yes | 184 |
| 214 | Yes | 214 |
| 268 | Yes | 268 |
| 283 | Yes | 283 |
| 405 | Yes | 405 |
| 463 | Yes | 463 |
| 567 | Yes | 567 |
| 646 | No | |

Variant protein T51958_P8 (SEQ ID NO:424) is encoded by the following transcript(s): T51958_T8 (SEQ ID NO:353), for which the sequence(s) is/are given at the end of the application. The coding portion of transcript T51958_T8 (SEQ ID NO:353) is shown in bold; this coding portion starts at position 222 and ends at position 2153. The transcript also has the following SNPs as listed in Table 437 (given according to their position on the nucleotide sequence, with the alternative nucleic acid listed; the last column indicates whether the SNP is known or not; the presence of known SNPs in variant protein T51958_P8 (SEQ ID NO:424) sequence provides support for the deduced sequence of this variant protein according to the present invention).

TABLE 437

Nucleic acid SNPs

| SNP position(s) on nucleotide sequence | Alternative nucleic acid(s) | Previously known SNP? |
|---|---|---|
| 841 | G -> A | Yes |
| 2072 | G -> A | Yes |
| 2270 | T -> G | Yes |
| 4635 | C -> | No |
| 4768 | T -> C | No |

Variant protein T51958_P13 (SEQ ID NO:425) according to the present invention has an amino acid sequence as given at the end of the application; it is encoded by transcript(s) T51958_T17 (SEQ ID NO:357). An alignment is given to the known protein (Tyrosine-protein kinase-like 7 precursor (SEQ ID NO:409)) at the end of the application. One or more alignments to one or more previously published protein sequences are given at the end of the application. A brief description of the relationship of the variant protein according to the present invention to each such aligned protein is as follows:

1. Comparison Report Between T51958_P13 (SEQ ID NO:425) and PTK7_HUMAN (SEQ ID NO:595):

A. An isolated chimeric polypeptide encoding for T51958_P13 (SEQ ID NO:425), comprising a first amino acid sequence being at least 90% homologous to MGAARG-
SPARPRRLPLLSVLLLPLLG- GTQTAIVFIKQPSSQDALQGRRALLRCEVEAPGPV HVYWLLDGAPVQDTERRFAQGSSLSFAAVD corresponding to amino acids 1-91 of PTK7_HUMAN (SEQ ID NO:595), which also corresponds to amino acids 1-91 of T51958_P13 (SEQ ID NO:425), a bridging amino acid R corresponding to amino acid 92 of T51958_P13 (SEQ ID NO:425), a second amino acid sequence being at least 90% homologous to LQDSGTFQCVARDDVTGEEARSANAS-FNIKWIEAGPVVLKHPASEAEIQPQTQV corresponding to amino acids 93-146 of PTK7_HUMAN (SEQ ID NO:595), which also corresponds to amino acids 93-146 of T51958_P13 (SEQ ID NO:425), a bridging amino acid T corresponding to amino acid 147 of T51958_P13 (SEQ ID NO:425), a third amino acid sequence being at least 90% homologous to LRCHIDGHPRPTYQWFRDGTPLS-DGQSNHTVSSKERNLTLRPAGPEHSGLYSCCAHSAF corresponding to amino acids 148-206 of PTK7_HUMAN (SEQ ID NO:595), which also corresponds to amino acids 148-206 of T51958_P13 (SEQ ID NO:425), a bridging amino acid G corresponding to amino acid 207 of T51958_P13 (SEQ ID NO:425), a fourth amino acid sequence being at least 90% homologous to QACSSQNFTLSIADESFARVV-LAPQDVVVARYEEAMFHCQFSAQP-PPSLQWLFEDETPITN RSRPPHLRRATV-FANGSLLLTQVRPRNAGIYRCIGQGQRGPPIILEATL-HLAEIEDMPLFEP RVFTAGSEERVTCLPPKGLPEPS-VWWEHAGVRLPTHGRVYQKGHELVLANI-AESDAGVY TCHAANLAGQRRQDVNITVA corresponding to amino acids 208-409 of PTK7_HUMAN (SEQ ID NO:595), which also corresponds to amino acids 208-409 of T51958_P13 (SEQ ID NO:425), a fifth bridging amino acid sequence comprising of N, a sixth amino acid sequence being at least 90% homologous to GSSLPEWVTDNAGTLH-FARVTRDDAGNYTCIASNGPQGQIRAH-VQLTVAVFITFKVEPER TTVYQGHTALLQCEAQGDP-KPLIQWKGKDRILDPTKLGPRMHIFQNGSLVIHDVA-PEDSG RYTCIAGNSCNIKHTEAPLYVVDK-PVPEESEGPGSPPPYKMIQTIGLSVGAAVAYIIAVLGL MFYCKKRCKAKRLQKQPEGEEPEME-CLNGGPLQNGQPSAEIQEEVALTSLGSGPAATNK RHSTSDKMHFPRSSLQPITTLGKSEF-GEVFLAKAQGLEEGVAETLVLVKSLQSKDEQQQL DFRRELEMFGKLNHANVVRLLGLCREAE-PHYMVLEYVDL corresponding to amino acids 541-880 of PTK7_HUMAN (SEQ ID NO:595), which also corresponds to amino acids 411-750 of T51958_P13 (SEQ ID NO:425), a bridging amino acid G corresponding to amino acid 751 of T51958_P13 (SEQ ID NO:425), a seventh amino acid sequence being at least 90% homologous to DLKQFLRISK-SKDEKLKSQPLSTKQKVALCTQVALGME-HLSNNRFVHKDLAARNCLVSA QRQVKVSALGL-SKDVYNSEYYHFRQAWV corresponding to amino acids 882-968 of PTK7_HUMAN (SEQ ID NO:595), which also corresponds to amino acids 752-838 of T51958_P13 (SEQ ID NO:425), a bridging amino acid P corresponding to amino acid 839 of T51958_P13 (SEQ ID NO:425), a eighth amino acid sequence being at least 90% homologous to LRWMS-PEAILEGDFSTKSDVWA corresponding to amino acids 970-991 of PTK7_HUMAN (SEQ ID NO:595), which also corresponds to amino acids 840-861 of T51958_P13 (SEQ ID NO:425), a bridging amino acid F corresponding to amino acid 862 of T51958_P13 (SEQ ID NO:425), and a nineth amino acid sequence being at least 90% homologous to GVLMWEVFTHGEMPHGGQADDEV-LADLQAGKARLPQPEGCPSKLYRLMQRCWALSPK DRPSFSEIASALGDSTVDSKP corresponding to amino acids 993-1070 of PTK7_HUMAN (SEQ ID NO:595), which also corresponds to amino acids 863-940 of T51958_P13 (SEQ ID NO:425), wherein said first amino acid sequence, bridging amino acid, second amino acid sequence, bridging amino acid, third amino acid sequence, bridging amino acid, fourth amino acid sequence, fifth amino acid sequence, sixth amino acid sequence, bridging amino acid, seventh amino acid sequence, bridging amino acid, eighth amino acid sequence, bridging amino acid and nineth amino acid sequence are contiguous and in a sequential order.

B. An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)–x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)–x), in which x varies from 0 to n-2.

2. Comparison Report Between T51958_P13 (SEQ ID NO:425) and NP_690619 (SEQ ID NO:412):

A. An isolated chimeric polypeptide encoding for T51958_P13 (SEQ ID NO:425), comprising a first amino acid sequence being at least 90% homologous to MGAARG-SPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of NP_690619 (SEQ ID NO:412), which also corresponds to amino acids 1-409 of T51958_P13 (SEQ ID NO:425), a second bridging amino acid sequence comprising of N, and a third amino acid sequence being at least 90% homologous to GSSLPEWVTDNAGTLHFARVTRD-DAGNYTCIASNGPQGQIRAHVQLTVAVFITFKVEPER TTVYQGHTALLQCEAQGDPKPLI-QWKGKDRILDPTKLGPRMHIFQNGSLVIHDVAPEDSG RYTCIAGNSCNIKHTEAPLYVVDK-PVPEESEGPGSPPPYKMIQTIGLSVGAAVAYIIAVLGL MFYCKKRCKAKRLQKQPEGEEPEME-CLNGGPLQNGQPSAEIQEEVALTSLGSGPAATNK RHSTSDKMHFPRSSLQPITTLGKSEF-GEVFLAKAQGLEEGVAETLVLVKSLQSKDEQQQL DFRRELEMFGKLNHANVVRLLGLCREAE-
PHYMVLEYVDLGDLKQFLRISKSKDEKLKSQ PLST-
KQKVALCTQVALGMEHLSNNRFVHKD-
LAARNCLVSAQRQVKVSALGLSKDVYNS
EYYHFRQAWVPLRWMSPEAILEGDF-
STKSDVWAFGVLMWEVFTHGEMPHGGQADDEV
LADLQAGKARLPQPEGCPSKLYRLM-
QRCWALSPKDRPSFSEIASALGDSTVDSKP corresponding to amino acids 501-1030 of NP_690619 (SEQ ID NO:412), which also corresponds to amino acids 411-940 of T51958_P13 (SEQ ID NO:425), wherein said first amino acid sequence, second amino acid sequence and third amino acid sequence are contiguous and in a sequential order.

B. An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

3. Comparison Report Between T51958_P13 (SEQ ID NO:425) and Q8NFA8_HUMAN (SEQ ID NO:416):

A. An isolated chimeric polypeptide encoding for T51958_P13 (SEQ ID NO:425), comprising a first amino acid sequence being at least 90% homologous to MGAARG-SPARPRRLPLLSVLLLPLLG-
GTQTAIVFIKQPSSQDALQGRRALLRCEVEAPGPV
HVYWLLDGAPVQDTERRFAQGSSLS-
FAAVDRLQDSGTFQCVARDDVTGEEARSANASFN
IKWIEAGPVVLKHPASEAEIQPQTQVTL-
RCHIDGHPRPTYQWFRDGTPLSDGQSNHTVSSK
ERNLTLRPAGPEHSGLYSCCAHSAF-
GQACSSQNFTLSIADESFARVVLAPQDVVVARYEE
AMFHCQFSAQPPPSLQWLFEDETPIT-
NRSRPPHLRRATVFANGSLLLTQVRPRNAGIYRCI
GQGQRGPPIILEATLHLAEIEDM-
PLFEPRVFTAGSEERVTCLPPKGLPEPS-
VWWEHAGVRL PTHGRVYQKGHELVLANIAES-
DAGVYTCHAANLAGQRRQDVNITVA corresponding to amino acids 1-409 of Q8NFA8_HUMAN (SEQ ID NO:416), which also corresponds to amino acids 1-409 of T51958_P13 (SEQ ID NO:425), a second bridging amino acid sequence comprising of N, and a third amino acid sequence being at least 90% homologous to GSSLPEWVTDNAGTLH-
FARVTRDDAGNYTCIASNGPQGQIRAH-
VQLTVAVFITFKVEPER TTVYQGHTALLQCEAQGDP-
KPLIQWKGKDRILDPTKLGPRMHIFQNGSLVIHDVA-
PEDSG RYTCIAGNSCNIKHTEAPLYVVDK-
PVPEESEGPGSPPPYKMIQTIGLSVGAAVAYIIAVLGL MFYCKKRCKAKRLQKQPEGEEPEME-
CLNGGPLQNGQPSAEIQEEVALTSLGSGPAATNK
RHSTSDKMHFPRSSLQPITTLGKSEF-
GEVFLAKAQGLEEGVAETLVLVKSLQSKDEQQQL
DFRRELEMFGKLNHANVVRLLGLCREAE-
PHYMVLEYVDLGDLKQFLRISKSKDEKLKSQ PLST-
KQKVALCTQVALGMEHLSNNRFVHKD-
LAARNCLVSAQRQVKVSALGLSKDVYNS
EYYHFRQAWVPLRWMSPEAILEGDF-
STKSDVWAFGVLMWEVFTHGEMPHGGQADDEV
LADLQAGKARLPQPEGCPSKLYRLM-
QRCWALSPKDRPSFSEIASALGDSTVDSKP corresponding to amino acids 501-1030 of Q8NFA8_HUMAN (SEQ ID NO:416), which also corresponds to amino acids 411-940 of T51958_P13 (SEQ ID NO:425), wherein said first amino acid sequence, second amino acid sequence and third amino acid sequence are contiguous and in a sequential order.

B. An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

4. Comparison Report Between T51958_P13 (SEQ ID NO:425) and NP_002812 (SEQ ID NO:413):

A. An isolated chimeric polypeptide encoding for T51958_P13 (SEQ ID NO:425), comprising a first amino acid sequence being at least 90% homologous to MGAARG-SPARPRRLPLLSVLLLPLLG-
GTQTAIVFIKQPSSQDALQGRRALLRCEVEAPGPV
HVYWLLDGAPVQDTERRFAQGSSLS-
FAAVDRLQDSGTFQCVARDDVTGEEARSANASFN
IKWIEAGPVVLKHPASEAEIQPQTQVTL-
RCHIDGHPRPTYQWFRDGTPLSDGQSNHTVSSK
ERNLTLRPAGPEHSGLYSCCAHSAF-
GQACSSQNFTLSIADESFARVVLAPQDVVVARYEE
AMFHCQFSAQPPPSLQWLFEDETPIT-
NRSRPPHLRRATVFANGSLLLTQVRPRNAGIYRCI
GQGQRGPPIILEATLHLAEIEDM-
PLFEPRVFTAGSEERVTCLPPKGLPEPS-
VWWEHAGVRL PTHGRVYQKGHELVLANIAES-
DAGVYTCHAANLAGQRRQDVNITVA corresponding to amino acids 1-409 of NP_002812 (SEQ ID NO:413), which also corresponds to amino acids 1-409 of T51958_P13 (SEQ ID NO:425), a second bridging amino acid sequence comprising of N, and a third amino acid sequence being at least 90% homologous to GSSLPEWVTDNAGTLHFARVTRD-
DAGNYTCIASNGPQGQIRAHVQLTVAVFITFKVEPER TTVYQGHTALLQCEAQGDPKPLI-
QWKGKDRILDPTKLGPRMHIFQNGSLVIHDVAPEDSG
RYTCIAGNSCNIKHTEAPLYVVDK-
PVPEESEGPGSPPPYKMIQTIGLSVGAAVAYIIAVLGL
MFYCKKRCKAKRLQKQPEGEEPEME-
CLNGGPLQNGQPSAEIQEEVALTSLGSGPAATNK
RHSTSDKMHFPRSSLQPITTLGKSEF-
GEVFLAKAQGLEEGVAETLVLVKSLQSKDEQQQL
DFRRELEMFGKLNHANVVRLLGLCREAE-
PHYMVLEYVDLGDLKQFLRISKSKDEKLKSQ PLST-
KQKVALCTQVALGMEHLSNNRFVHKD-
LAARNCLVSAQRQVKVSALGLSKDVYNS
EYYHFRQAWVPLRWMSPEAILEGDF-
STKSDVWAFGVLMWEVFTHGEMPHGGQADDEV
LADLQAGKARLPQPEGCPSKLYRLM-
QRCWALSPKDRPSFSEIASALGDSTVDSKP corresponding to amino acids 541-1070 of NP_002812 (SEQ ID NO:413), which also corresponds to amino acids 411-940 of T51958_P13 (SEQ ID NO:425), wherein said first amino acid sequence, second amino acid sequence and third amino acid sequence are contiguous and in a sequential order.

B. An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

5. Comparison Report Between T51958_P13 (SEQ ID NO:425) and Q6IQ54_HUMAN (SEQ ID NO:419):

A. An isolated chimeric polypeptide encoding for T51958_P13 (SEQ ID NO:425), comprising a first amino acid sequence being at least 90% homologous to MGAARG-SPARPRRLPLLSVLLLPLLG-
GTQTAIVFIKQPSSQDALQGRRALLRCEVEAPGPV
HVYWLLDGAPVQDTERRFAQGSSLSFAAVDR corresponding to amino acids 1-92 of Q6IQ54_HUMAN (SEQ ID NO:419), which also corresponds to amino acids 1-92 of T51958_P13 (SEQ ID NO:425), a bridging amino acid L corresponding to amino acid 93 of T51958_P13 (SEQ ID NO:425), a second amino acid sequence being at least 90% homologous to QDSGTFQCVARDDVTGEEARSANAS-
FNIKWIEAGPVVLKBPASEAEIQPQTQVTLRCHID
GHPRPTYQWFRDGTPLSDGQS-
NHTVSSKERNLTLRPAGPEHSGLY-
SCCAHSAFGQACSSQ NFTLSLADESFARVVLAPQDV-
VVARYEEAMFHCQFSAQPPPSLQWLFEDETPITNRS-
RPPH LRRATVFANGSLLLTQVRPRNAGIYR-
CIGQGQRGPPIILEATLHLAEEEDMPLFEPRVFTAG SEERVTCLPPKGLPEPSVWWEHAGVR-
LPTHGRVYQKGHELVLANIAESDAGVYTCHAAN
LAGQRRQDVNITVA corresponding to amino acids 94-409 of Q6IQ54_HUMAN (SEQ ID NO:419), which also corresponds to amino acids 94-409 of T51958_P13 (SEQ ID NO:425), a third bridging amino acid sequence comprising of N, and a fourth amino acid sequence being at least 90% homologous to GSSLPEWVTDNAGTLHFARVTRDDAG-
NYTCIASNGPQGQIRAHVQLTVAVFITFKVEPER
TTVYQGHTALLQCEAQGDPKPLI-
QWKGKDRILDPTKLGPRMHIFQNGSLVIHDVAPEDSG
RYTCIAGNSCNIKHTEAPLYVVDK-
PVPEESEGPGSPPPYKMIQTIGLSVGAAVAYIIAVLGL
MFYCKKRCKAKRLQKQPEGEEPEME-
CLNGGPLQNGQPSAEIQEEVALTSLGSGPAATNK
RHSTSDKMHFPRSSLQPITTLGKSEF-
GEVFLAKAQGLEEGVAETLVLVKSLQSKDEQQQL
DFRRELEMFGKLNHANVVRLLGLCREAE-
PHYMVLEYVDLGDLKQFLRISKSKDEKLKSQ PLST-
KQKVALCTQVALGMEHLSNNRFVHKD-
LAARNCLVSAQRQVKVSALGLSKDVYNS
EYYHFRQAWVPLRWMSPEAILEGDF-
STKSDVWAFGVLMWEVFTHGEMPHGGQADDEV
LADLQAGKARLPQPEGCPSKLYRLM-
QRCWALSPKDRPSFSEIASALGDSTVDSKP corresponding to amino acids 541-1070 of Q6IQ54_HUMAN (SEQ ID NO:419), which also corresponds to amino acids 411-940 of T51958_P13 (SEQ ID NO:425), wherein said first amino acid sequence, bridging amino acid, second amino acid sequence, third amino acid sequence and fourth amino acid sequence are contiguous and in a sequential order.

B. An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

6. Comparison Report Between T51958_P13 (SEQ ID NO:425) and Q8NFA6_HUMAN (SEQ ID NO:418):

A. An isolated chimeric polypeptide encoding for T51958_P13 (SEQ ID NO:425), comprising a first amino acid sequence being at least 90% homologous to MGAARG-SPARPRRLPLLSVLLLPLLG-
GTQTAIVFIKQPSSQDALQGRRALLRCEVEAPGPV
HVYWLLDGAPVQDTERRFAQGSSLS-
FAAVDRLQDSGTFQCVARDDVTGEEARSANASFN
IKWIEAGPVVLKHPASEAEIQPQTQVTL-
RCHIDGHPRPTYQWFRDGTPLSDGQSNHTVSSK ERNLTLRPAGPEHSGLYSCCAHSAF-GQACSSQNFTLSIADESFARVVLAPQDVVVARYEEAMFHCQFSAQPPPSLQWLFEDETPIT-NRSRPPHLRRATVFANGSLLLTQVRPRNAGIYRCIGQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of Q8NFA6_HUMAN (SEQ ID NO:418), which also corresponds to amino acids 1-409 of T51958_P13 (SEQ ID NO:425), a second bridging amino acid sequence comprising of N, a third amino acid sequence being at least 90% homologous to GSSLPEWVTDNAGTLHFARVTRD-DAGNYTCIASNGPQGQIRAHVQLTVAVFITFKVEPER TTVYQGHTALLQCEAQGDPKPLIQWK corresponding to amino acids 541-626 of Q8NFA6_HUMAN (SEQ ID NO:418), which also corresponds to amino acids 411-496 of T51958_P13 (SEQ ID NO:425), a fourth amino acid sequence being at least 70%, optionally at least 80%, preferably at least 85%, more preferably at least 90% and most preferably at least 95% homologous to a polypeptide having the sequence GKDRILDPTKLGPRMHIFQNGSLVIHD-VAPEDSGRYTCIAGNSCNIKHTEAPLYVV (SEQ ID NO:628) corresponding to amino acids 497-552 of T51958_P13 (SEQ ID NO:425), and a fifth amino acid sequence being at least 90% homologous to DKPVPEESEG-PGSPPPYKMIQTIGLSVGAAVAYIIAV-LGLMFYCKKRCKAKRLQKQPEGEE PEMECLNGG-PLQNGQPSAEIQEEVALTSLGSGPAATNKRHSTSDK-MHFPRSSLQPITTLGK SEFGEVFLAKAQGLEEGVA-ETLVLVKSLQSKDEQQQLDFRRELEMF-GKLNHANVVRLLG LCREAEPHYMV-LEYVDLGDLKQFLRISKSKDEKLKSQPLSTKQKVAL-CTQVALGMEHLS NNRFVHKDLAARN-CLVSAQRQVKVSALGLSKDVYNSEYYH-FRQAWVPLRWMSPEAILE GDFSTKSDVWAFGVLM-WEVFTHGEMPHGGQADDEVLADLQAGKARLPQPE-GCPSKLYR LMQRCWALSPKDRPSFSEIASALGD-STVDSKP corresponding to amino acids 627-1014 of Q8NFA6_HUMAN (SEQ ID NO:418), which also corresponds to amino acids 553-940 of T51958_P13 (SEQ ID NO:425), wherein said first amino acid sequence, second amino acid sequence, third amino acid sequence, fourth amino acid sequence and fifth amino acid sequence are contiguous and in a sequential order.

B. An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)−x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)−x), in which x varies from 0 to n-2.

C. An isolated polypeptide encoding for an edge portion of T51958_P13 (SEQ ID NO:425), comprising an amino acid sequence being at least 70%, optionally at least about 80%, preferably at least about 85%, more preferably at least about 90% and most preferably at least about 95% homologous to the sequence GKDRILDPTKLGPRMHIFQNGSLVIIID-VAPEDSGRYTCIAGNSCNIKHTEAPLYVV (SEQ ID NO:628) of T51958_P13 (SEQ ID NO:425).

7. Comparison Report Between T51958_P13 (SEQ ID NO:425) and NP_690621 (SEQ ID NO:410):

A. An isolated chimeric polypeptide encoding for T51958_P13 (SEQ ID NO:425), comprising a first amino acid sequence being at least 90% homologous to MGAARG-SPARPRRLPLLSVLLLPLLG-GTQTAIVFIKQPSSQDALQGRRALLRCEVEAPGPVHVYWLLDGAPVQDTERRFAQGSSLS-FAAVDRLQDSGTFQCVARDDVTGEEARSANASFNIKWIEAGPVVLKHPASEAEIQPQTQVTL-RCHIDGHPRPTYQWFRDGTPLSDGQSNHTVSSKERNLTLRPAGPEHSGLYSCCAHSAF-GQACSSQNFTLSIADESFARVVLAPQDVVVARYEEAMFHCQFSAQPPPSLQWLFEDETPIT-NRSRPPHLRRATVFANGSLLLTQVRPRNAGIYRCIGQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of NP_690621 (SEQ ID NO:410), which also corresponds to amino acids 1-409 of T51958_P13 (SEQ ID NO:425), a second bridging amino acid sequence comprising of N, a third amino acid sequence being at least 90% homologous to GSSLPEWVTDNAGTLHFARVTRDDAG-NYTCIASNGPQGQIRAHVQLTVAVFITFKVEPER TTVYQGHTALLQCEAQGDPKPLIQWK corresponding to amino acids 541-626 of NP_690621 (SEQ ID NO:410), which also corresponds to amino acids 411-496 of T51958_P13 (SEQ ID NO:425), a fourth amino acid sequence being at least 70%, optionally at least 80%, preferably at least 85%, more preferably at least 90% and most preferably at least 95% homologous to a polypeptide having the sequence GKDRILDPTKLGPRMHIFQNGSLVIHD-VAPEDSGRYTCIAGNSCNIKHTEAPLYVV (SEQ ID NO:628) corresponding to amino acids 497-552 of T51958_P13 (SEQ ID NO:425), and a fifth amino acid sequence being at least 90% homologous to DKPVPEESEG-PGSPPPYKMIQTIGLSVGAAVAYIIAV-LGLMFYCKKRCKAKRLQKQPEGEE PEMECLNGG-PLQNGQPSAEIQEEVALTSLGSGPAATNKRHSTSDK-MHFPRSSLQPITTLGK SEFGEVFLAKAQGLEEGVA-ETLVLVKSLQSKDEQQQLDFRRELEMF-GKLNHANVVRLLG LCREAEPHYMV-LEYVDLGDLKQFLRISKSKDEKLKSQPLSTKQKVAL-CTQVALGMEHLS NNRFVHKDLAARN-CLVSAQRQVKVSALGLSKDVYNSEYYH-FRQAWVPLRWMSPEAILE GDFSTKSDVWAFGVLM-WEVFTHGEMPHGGQADDEVLADLQAGKARLPQPE-GCPSKLYR LMQRCWALSPKDRPSFSEIASALGD-STVDSKP corresponding to amino acids 627-1014 of NP_690621 (SEQ ID NO:410), which also corresponds to amino acids 553-940 of T51958_P13 (SEQ ID NO:425), wherein said first amino acid sequence, second amino acid sequence, third amino acid sequence, fourth amino acid sequence and fifth amino acid sequence are contiguous and in a sequential order.

B. An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)−x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)−x), in which x varies from 0 to n-2.

C. An isolated polypeptide encoding for an edge portion of T51958_P13 (SEQ ID NO:425), comprising an amino acid sequence being at least 70%, optionally at least about 80%, preferably at least about 85%, more preferably at least about 90% and most preferably at least about 95% homologous to the sequence GKDRILDPTKLGPRMHIFQNGSLVIHD-VAPEDSGRYTCIAGNSCNIKHTEAPLYVV (SEQ ID NO:628) of T51958_P13 (SEQ ID NO:425).

8. Comparison Report Between T51958_P13 (SEQ ID NO:425) and NP_690622 (SEQ ID NO:414):

A. An isolated chimeric polypeptide encoding for T51958_P13 (SEQ ID NO:425), comprising a first amino acid sequence being at least 90% homologous to MGAARG-SPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of NP_690622 (SEQ ID NO:414), which also corresponds to amino acids 1-409 of T51958_P13 (SEQ ID NO:425), a second bridging amino acid sequence comprising of N, a third amino acid sequence being at least 90% homologous to GSSLPEWVTDNAGTLHFARVTRDDAG-NYTCIASNGPQGQRAHVQLTVAVFITFKVEPER TTVYQGHTALLQCEAQGDPKPLI-QWKGKDRILDPTKLGPRMHIFQNGSLVIHDVAPEDSG RYTCIAGNSCNIKHTEAPLYVVDK-PVPEESEGPGSPPPYKMIQTIGLSVGAAVAYIIAVLGL MFYCKKRCKAKRLQKQPEGEEPEME-CLNGGPLQNGQPSAEIQEEVALTSLGSGPAATNK RHSTSDKMHFPRSSLQPITTLG corresponding to amino acids 541-803 of NP_690622 (SEQ ID NO:414), which also corresponds to amino acids 411-673 of T51958_P13 (SEQ ID NO:425), and a fourth amino acid sequence being at least 70%, optionally at least 80%, preferably at least 85%, more preferably at least 90% and most preferably at least 95% homologous to a polypeptide having the sequence KSEF-GEVFLAKAQGLEEGVAETLVLVK-SLQSKDEQQQLDFRRELEMFGKLNHANVVRLL GLCREAEPHYMVLEYVDLGDLKQFL-RISKSKDEKLKSQPLSTKQKVALCTQVALGMEHL SNNRFVHKDLAARNCLVSAQRQVKVSAL-GLSKDVYNSEYYHFRQAWVPLRWMSPEAIL EGDF-STKSDVWAFGVLMWEVFTHGEMPHG-GQADDEVLADLQAGKARLPQPEGCPSKLY RLMQRCWALSPKDRPSFSEIASALGDSTVDSKP (SEQ ID NO:629) corresponding to amino acids 674-940 of T51958_P13 (SEQ ID NO:425), wherein said first amino acid sequence, second amino acid sequence, third amino acid sequence and fourth amino acid sequence are contiguous and in a sequential order.

B. An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)−x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)−x), in which x varies from 0 to n-2.

C. An isolated polypeptide encoding for an edge portion of T51958_P13 (SEQ ID NO:425), comprising an amino acid sequence being at least 70%, optionally at least about 80%, preferably at least about 85%, more preferably at least about 90% and most preferably at least about 95% homologous to the sequence KSEFGEVFLAKAQGLEEGVAETLVLVK-SLQSKDEQQQLDFRRELEMFGKLNHANVVRLL GLCREAEPHYMVLEYVDLGDLKQFL-RISKSKDEKLKSQPLSTKQKVALCTQVALGMEHL SNNRFVHKDLAARNCLVSAQRQVKVSAL-GLSKDVYNSEYYHFRQAWVPLRWMSPEAI EGDF-STKSDVWAFGVLMWEVFTHGEMPHG-GQADDEVLADLQAGKARLPQPEGCPSKLY RLMQRCWALSPKDRPSFSEIASALGDSTVDSKP (SEQ ID NO:629) of T51958_P13 (SEQ ID NO:425).

9. Comparison Report Between T51958_P13 (SEQ ID NO:425) and Q8NFA5_HUMAN (SEQ ID NO:420):

A. An isolated chimeric polypeptide encoding for T51958_P13 (SEQ ID NO:425), comprising a first amino acid sequence being at least 90% homologous to MGAARG-SPARPRRLPLLSVLLLPLLG- GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of Q8NFA5_HUMAN (SEQ ID NO:420), which also corresponds to amino acids 1-409 of T51958_P13 (SEQ ID NO:425), a second bridging amino acid sequence comprising of N, a third amino acid sequence being at least 90% homologous to GSSLPEWVTDNAGTLHFARVTRD-DAGNYTCIASNGPQGQIRAHVQLTVAVFITFKVEPER TTVYQGHTALLQCEAQGDPKPLI-QWKGKDRILDPTKLGPRMHEFQNGSLVI-HDVAPEDSG RYTCIAGNSCNIKHTEAPLYVVDK-PVPEESEGPGSPPPYKMIQTIGLSVGAAVAYIIAVLGL MFYCKKRCKAKRLQKQPEGEEPEME-CLNGGPLQNGQPSAEIQEEVALTSLGSGPAATNK RHSTSDKMHFPRSSLQPITTLG corresponding to amino acids 541-803 of Q8NFA5_HUMAN (SEQ ID NO:420), which also corresponds to amino acids 411-673 of T51958_P13 (SEQ ID NO:425), and a fourth amino acid sequence being at least 70%, optionally at least 80%, preferably at least 85%, more preferably at least 90% and most preferably at least 95% homologous to a polypeptide having the sequence KSEFGEVFLAKAQGLEEGVAETLVLVK-SLQSKDEQQQLDFRRELEMFGKLNHANVVRLL GLCREAEPHYMVLEYVDLGDLKQFL-RISKSKDEKLKSQPLSTKQKVALCTQVALGMEHL SNNRFVHKDLAARNCLVSAQRQVKVSAL-GLSKDVYNSEYYHFRQAWVPLRWMSPEAIL EGDF-STKSDVWAFGVLMWEVFTHGEMPHG-GQADDEVLADLQAGKARLPQPEGCPSKLY RLMQRCWALSPKDRPSFSEIASALGDSTVDSKP (SEQ ID NO:629) corresponding to amino acids 674-940 of T51958_P13 (SEQ ID NO:425), wherein said first amino acid sequence, second amino acid sequence, third amino acid sequence and fourth amino acid sequence are contiguous and in a sequential order.

B. An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AN having a structure as follows (numbering according to T51958_P13): a sequence starting from any of amino acid numbers 409-x to 409; and ending at any of amino acid numbers 410+((n-2)-x), in which x varies from 0 to n-2.

An isolated polypeptide encoding for an edge portion of T51958_P13 (SEQ ID NO:425), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NG having a structure as follows (numbering according to T51958_P13): a sequence starting from any of amino acid numbers 410-x to 410; and ending at any of amino acid numbers 411+((n-2)-x), in which x varies from 0 to n-2.

C. An isolated polypeptide encoding for an edge portion of T51958_P13 (SEQ ID NO:425), comprising an amino acid sequence being at least 70%, optionally at least about 80%, preferably at least about 85%, more preferably at least about 90% and most preferably at least about 95% homologous to the sequence KSEFGEVFLAKAQGLEEGVAETLVLVK-SLQSKDEQQQLDFRRELEMFGKLNHANVVRLL GLCREAEPHYMVLEYVDLGDLKQFL-RISKSKDEKLKSQPLSTKQKVALCTQVALGMEHL SNNRFVHKDLAARNCLVSAQRQVKVSAL-GLSKDVYNSEYYHFRQAWVPLRWMSPEAIL EGDF-STKSDVWAFGVLMWEVFTHGEMPHG-GQADDEVLADLQAGKARLPQPEGCPSKLY RLMQRCWALSPKDRPSFSEIASALGDSTVDSKP (SEQ ID NO:629) of T51958_P13 (SEQ ID NO:425).

The localization of the variant protein was determined according to results from a number of different software programs and analyses, including analyses from SignalP and other specialized programs. The variant protein is believed to be located as follows with regard to the cell: membrane.

Variant protein T51958_P13 (SEQ ID NO:425) also has the following non-silent SNPs (Single Nucleotide Polymorphisms) as listed in Table 438, (given according to their position(s) on the amino acid sequence, with the alternative amino acid(s) listed; the last column indicates whether the SNP is known or not; the presence of known SNPs in variant protein T51958_P13 (SEQ ID NO:425) sequence provides support for the deduced sequence of this variant protein according to the present invention).

TABLE 438

Amino acid mutations

| SNP position(s) on amino acid sequence | Alternative amino acid(s) | Previously known SNP? |
|---|---|---|
| 207 | G -> D | Yes |

The glycosylation sites of variant protein T51958_P13 (SEQ ID NO:425), as compared to the know protein Tyrosine-protein kinase-like 7 precursor (SEQ ID NO:409), are described in Table 439 (given according to their position(s) on the amino acid sequence in the first column; the second column indicates whether the glycosylation site is present in the variant protein; and the last column indicates whether the position is different on the variant protein).

TABLE 439

Glycosylation site(s)

| Position(s) on known amino acid sequence | Present in variant protein? | Position(s) on variant protein |
|---|---|---|
| 116 | Yes | 116 |
| 175 | Yes | 175 |
| 184 | Yes | 184 |
| 214 | Yes | 214 |
| 268 | Yes | 268 |
| 283 | Yes | 283 |
| 405 | Yes | 405 |
| 437 | Yes | 437 |
| 463 | No | |
| 516 | Yes | 516 |

Variant protein T51958_P13 (SEQ ID NO:425) is encoded by the following transcript(s): T51958_T17 (SEQ ID NO:357), for which the sequence(s) is/are given at the end of the application. The coding portion of transcript T51958_T17 (SEQ ID NO:357) is shown in bold; this coding portion starts at position 222 and ends at position 3041. The transcript also has the following SNPs as listed in Table 440 (given according to their position on the nucleotide sequence, with the alternative nucleic acid listed; the last column indicates whether the SNP is known or not; the presence of known SNPs in variant protein T51958_P13 (SEQ ID NO:425) sequence provides support for the deduced sequence of this variant protein according to the present invention).

TABLE 440

| SNP position(s) on nucleotide sequence | Nucleic acid SNPs Alternative nucleic acid(s) | Previously known SNP? |
|---|---|---|
| 841 | G -> A | Yes |
| 1682 | G -> A | Yes |
| 3144 | C -> | No |
| 3277 | T -> C | No |

Variant protein T51958_P27 (SEQ ID NO:426) according to the present invention has an amino acid sequence as given at the end of the application; it is encoded by transcript(s) T51958_T37 (SEQ ID NO:359) and T51958_T38 (SEQ ID NO:360). An alignment is given to the known protein (Tyrosine-protein kinase-like 7 precursor (SEQ ID NO:409)) at the end of the application. One or more alignments to one or more previously published protein sequences are given at the end of the application. A brief description of the relationship of the variant protein according to the present invention to each such aligned protein is as follows:

1. Comparison Report Between T51958_P27 (SEQ ID NO:426) and NP__690622 (SEQ ID NO:414):

A. An isolated chimeric polypeptide encoding for T51958_P27 (SEQ ID NO:426), comprising a first amino acid sequence being at least 90% homologous to MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of NP__690622 (SEQ ID NO:414), which also corresponds to amino acids 1-409 of T51958_P27 (SEQ ID NO:426), and a second amino acid sequence being at least 70%, optionally at least 80%, preferably at least 85%, more preferably at least 90% and most preferably at least 95% homologous to a polypeptide having the sequence SEHLCPEGQGEVEGNTGLGVMDRGFPGTHL-RSSQFWALQAWESVHYWESV (SEQ ID NO:630) corresponding to amino acids 410-459 of T51958_P27 (SEQ ID NO:426), wherein said first amino acid sequence and second amino acid sequence are contiguous and in a sequential order.

B. An isolated polypeptide encoding for an edge portion of T51958_P27 (SEQ ID NO:426), comprising an amino acid sequence being at least 70%, optionally at least about 80%, preferably at least about 85%, more preferably at least about 90% and most preferably at least about 95% homologous to the sequence SEHLCPEGQGEVEGNTGLGVMDRGFPGTHLRSSQFWALQAWESVHYWESV (SEQ iID NO:630) of T51958_P27 (SEQ ID NO:426).

2. Comparison Report Between T51958_P27 (SEQ ID NO:426) and Q8NFA5_HUMAN (SEQ ID NO:420):

A. An isolated chimeric polypeptide encoding for T51958_P27 (SEQ ID NO:426), comprising a first amino acid sequence being at least 90% homologous to MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of Q8NFA5_HUMAN (SEQ ID NO:420), which also corresponds to amino acids 1-409 of T51958_P27 (SEQ ID NO:426), and a second amino acid sequence being at least 70%, optionally at least 80%, preferably at least 85%, more preferably at least 90% and most preferably at least 95% homologous to a polypeptide having the sequence SEHLCPEGQGEVEGNTGLGVMDRGFPGTHL-RSSQFWALQAWESVHYWESV (SEQ iID NO:630) corresponding to amino acids 410-459 of T51958_P27 (SEQ ID NO:426), wherein said first amino acid sequence and second amino acid sequence are contiguous and in a sequential order.

B. An isolated polypeptide encoding for an edge portion of T51958_P27 (SEQ ID NO:426), comprising an amino acid sequence being at least 70%, optionally at least about 80%, preferably at least about 85%, more preferably at least about 90% and most preferably at least about 95% homologous to the sequence SEHLCPEGQGEVEGNTGLGVMDRGFPGTHLRSSQFWALQAWESVHYWESV (SEQ ID NO:630) of T51958_P27 (SEQ ID NO:426).

The localization of the variant protein was determined according to results from a number of different software programs and analyses, including analyses from SignalP and other specialized programs. The variant protein is believed to be located as follows with regard to the cell: secreted.

Variant protein T51958_P27 (SEQ ID NO:426) also has the following non-silent SNPs (Single Nucleotide Polymorphisms) as listed in Table 441, (given according to their position(s) on the amino acid sequence, with the alternative amino acid(s) listed; the last column indicates whether the SNP is known or not; the presence of known SNPs in variant protein T51958_P27 (SEQ ID NO:426) sequence provides support for the deduced sequence of this variant protein according to the present invention).

TABLE 441

Amino acid mutations

| SNP position(s) on amino acid sequence | Alternative amino acid(s) | Previously known SNP? |
|---|---|---|
| 207 | G -> D | Yes |
| 455 | Y -> C | Yes |

The glycosylation sites of variant protein T51958_P27 (SEQ ID NO:426), as compared to the known protein Tyrosine-protein kinase-like 7 precursor (SEQ ID NO:409), are described in Table 442 (given according to their position(s) on the amino acid sequence in the first column; the second column indicates whether the glycosylation site is present in the variant protein; and the last column indicates whether the position is different on the variant protein).

TABLE 442

Glycosylation site(s)

| Position(s) on known amino acid sequence | Present in variant protein? | Position(s) on variant protein |
|---|---|---|
| 116 | Yes | 116 |
| 175 | Yes | 175 |
| 184 | Yes | 184 |
| 214 | Yes | 214 |
| 268 | Yes | 268 |
| 283 | Yes | 283 |
| 405 | Yes | 405 |
| 463 | No | |
| 567 | No | |
| 646 | No | |

Variant protein T51958_P27 (SEQ ID NO:426) is encoded by the following transcript(s): T51958_T37 (SEQ ID NO:359) and T51958_T38 (SEQ ID NO:360), for which the sequence(s) is/are given at the end of the application.

The coding portion of transcript T51958_T37 (SEQ ID NO:359) is shown in bold; this coding portion starts at position 222 and ends at position 1598. The transcript also has the following SNPs as listed in Table 443 (given according to their position on the nucleotide sequence, with the alternative nucleic acid listed; the last column indicates whether the SNP is known or not; the presence of known SNPs in variant protein T51958_P27 (SEQ ID NO:426) sequence provides support for the deduced sequence of this variant protein according to the present invention).

TABLE 443

Nucleic acid SNPs

| SNP position(s) on nucleotide sequence | Alternative nucleic acid(s) | Previously known SNP? |
|---|---|---|
| 841 | G -> A | Yes |
| 1585 | A -> G | Yes |
| 2294 | C -> G | Yes |

The coding portion of transcript T51958_T38 (SEQ ID NO:360) is shown in bold; this coding portion starts at position 222 and ends at position 1598. The transcript also has the following SNPs as listed in Table 444 (given according to their position on the nucleotide sequence, with the alternative nucleic acid listed; the last column indicates whether the SNP is known or not; the presence of known SNPs in variant protein T51958_P27 (SEQ ID NO:426) sequence provides support for the deduced sequence of this variant protein according to the present invention).

TABLE 444

Nucleic acid SNPs

| SNP position(s) on nucleotide sequence | Alternative nucleic acid(s) | Previously known SNP? |
|---|---|---|
| 841 | G -> A | Yes |
| 1585 | A -> G | Yes |
| 2294 | C -> G | Yes |
| 2694 | T -> C | Yes |

Variant protein T51958_P29 (SEQ ID NO:427) according to the present invention has an amino acid sequence as given at the end of the application; it is encoded by transcript(s) T51958_T40 (SEQ ID NO:361).

The localization of the variant protein was determined according to results from a number of different software programs and analyses, including analyses from SignalP and other specialized programs. The variant protein is believed to be located as follows with regard to the cell: secreted.

The glycosylation sites of variant protein T51958_P29 (SEQ ID NO:427), as compared to the know protein Tyrosine-protein kinase-like 7 precursor (SEQ ID NO:409), are described in Table 445 (given according to their position(s) on the amino acid sequence in the first column; the second column indicates whether the glycosylation site is present in the variant protein; and the last column indicates whether the position is different on the variant protein).

TABLE 445

Glycosylation site(s)

| Position(s) on known amino acid sequence | Present in variant protein? | Position(s) on variant protein |
|---|---|---|
| 116 | Yes | 116 |
| 175 | No | |
| 184 | No | |
| 214 | No | |
| 268 | No | |
| 283 | No | |
| 405 | No | |
| 463 | No | |
| 567 | No | |
| 646 | No | |

Variant protein T51958_P29 (SEQ ID NO:427) is encoded by the following transcript(s): T51958_T40 (SEQ ID NO:361), for which the sequence(s) is/are given at the end of the application. The coding portion of transcript T51958_T40 (SEQ ID NO:361) is shown in bold; this coding portion starts at position 222 and ends at position 638.

Variant protein T51958_P59 (SEQ ID NO:428) according to the present invention has an amino acid sequence as given at the end of the application; it is encoded by transcript(s) T51958_T2 (SEQ ID NO:351).

The localization of the variant protein was determined according to results from a number of different software programs and analyses, including analyses from SignalP and other specialized programs. The variant protein is believed to be located as follows with regard to the cell: secreted.

Variant protein T51958_P59 (SEQ ID NO:428) also has the following non-silent SNPs (Single Nucleotide Polymorphisms) as listed in Table 446, (given according to their position(s) on the amino acid sequence, with the alternative amino acid(s) listed; the last column indicates whether the SNP is known or not; the presence of known SNPs in variant protein T51958_P59 (SEQ ID NO:428) sequence provides support for the deduced sequence of this variant protein according to the present invention).

TABLE 446

Amino acid mutations

| SNP position(s) on amino acid sequence | Alternative amino acid(s) | Previously known SNP? |
|---|---|---|
| 207 | G -> D | Yes |

The glycosylation sites of variant protein T51958_P59 (SEQ ID NO:428), as compared to known protein Tyrosine-protein kinase-like 7 precursor (SEQ ID NO:409), are described in Table 447 (given according to their position(s) on the amino acid sequence in the first column; the second column indicates whether the glycosylation site is present in the variant protein; and the last column indicates whether the position is different on the variant protein).

TABLE 447

Glycosylation site(s)

| Position(s) on known amino acid sequence | Present in variant protein? | Position(s) on variant protein |
|---|---|---|
| 116 | Yes | 116 |
| 175 | Yes | 175 |
| 184 | Yes | 184 |
| 214 | Yes | 214 |
| 268 | No | |
| 283 | No | |
| 405 | No | |
| 463 | No | |
| 567 | No | |
| 646 | No | |

Variant protein T51958_P59 (SEQ ID NO:428) is encoded by the following transcript(s): T51958_T2 (SEQ ID NO:351), for which the sequence(s) is/are given at the end of the application. The coding portion of transcript T51958_T2 (SEQ ID NO:351) is shown in bold; this coding portion starts at position 222 and ends at position 914. The transcript also has the following SNPs as listed in Table 448 (given according to their position on the nucleotide sequence, with the alternative nucleic acid listed; the last column indicates whether the SNP is known or not; the presence of known SNPs in variant protein T51958_P59 (SEQ ID NO:428) sequence provides support for the deduced sequence of this variant protein according to the present invention).

TABLE 448

Nucleic acid SNPs

| SNP position(s) on nucleotide sequence | Alternative nucleic acid(s) | Previously known SNP? |
|---|---|---|
| 841 | G -> A | Yes |
| 2162 | G -> A | Yes |
| 3624 | C -> | No |
| 3757 | T -> C | No |

Variant protein T51958_P60 (SEQ ID NO:429) according to the present invention has an amino acid sequence as given at the end of the application; it is encoded by transcript(s) T51958_T13 (SEQ ID NO:356) and T51958_T7 (SEQ ID NO:352).

The localization of the variant protein was determined according to results from a number of different software programs and analyses, including analyses from SignalP and other specialized programs. The variant protein is believed to be located as follows with regard to the cell: secreted.

The glycosylation sites of variant protein T51958_P60 (SEQ ID NO:429), as compared to the known protein Tyrosine-protein kinase-like 7 precursor (SEQ ID NO:409), are described in Table 449 (given according to their position(s) on the amino acid sequence in the first column; the second column indicates whether the glycosylation site is present in the variant protein; and the last column indicates whether the position is different on the variant protein).

TABLE 449

Glycosylation site(s)

| Position(s) on known amino acid sequence | Present in variant protein? | Position(s) on variant protein |
|---|---|---|
| 116 | Yes | 116 |
| 175 | No | |
| 184 | No | |
| 214 | No | |
| 268 | No | |
| 283 | No | |
| 405 | No | |
| 463 | No | |
| 567 | No | |
| 646 | No | |

Variant protein T51958_P60 (SEQ ID NO:429) is encoded by the following transcript(s): T51958_T13 (SEQ ID NO:356) and T51958_T7 (SEQ ID NO:352), for which the sequence(s) is/are given at the end of the application.

The coding portion of transcript T51958_T13 (SEQ ID NO:356) is shown in bold; this coding portion starts at position 222 and ends at position 692. The transcript also has the following SNPs as listed in Table 450 (given according to their position on the nucleotide sequence, with the alternative nucleic acid listed; the last column indicates whether the SNP is known or not; the presence of known SNPs in variant protein T51958_P60 (SEQ ID NO:429) sequence provides support for the deduced sequence of this variant protein according to the present invention).

TABLE 450

Nucleic acid SNPs

| SNP position(s) on nucleotide sequence | Alternative nucleic acid(s) | Previously known SNP? |
|---|---|---|
| 1881 | G -> A | Yes |
| 3338 | C -> | No |
| 3471 | T -> C | No |

The coding portion of transcript T51958_T7 (SEQ ID NO:352) is shown in bold; this coding portion starts at position 222 and ends at position 692. The transcript also has the following SNPs as listed in Table 451 (given according to their position on the nucleotide sequence, with the alternative nucleic acid listed; the last column indicates whether the SNP is known or not; the presence of known SNPs in variant protein T51958_P60 (SEQ ID NO:429) sequence provides support for the deduced sequence of this variant protein according to the present invention).

TABLE 451

| Nucleic acid SNPs | | |
| --- | --- | --- |
| SNP position(s) on nucleotide sequence | Alternative nucleic acid(s) | Previously known SNP? |
| 1881 | G -> A | Yes |
| 3343 | C -> | No |
| 3476 | T -> C | No |

Variant protein T51958_P5 (SEQ ID NO:633) according to the present invention has an amino acid sequence as given at the end of the application; it is encoded by transcript(s) T51958_T20 (SEQ ID NO:632) and T51958_T5 (SEQ ID NO:631). An alignment is given to the known protein (Tyrosine-protein kinase-like 7 precursor) at the end of the application. One or more alignments to one or more previously published protein sequences are given at the end of the application. A brief description of the relationship of the variant protein according to the present invention to each such aligned protein is as follows:

1. Comparison Report Between T51958_P5 (SEQ ID NO:633) and PTK7_HUMAN (SEQ ID NO:595):

A. An isolated chimeric polypeptide encoding for T51958_P5 (SEQ ID NO:633), comprising a first amino acid sequence being at least 90% homologous to MGAARGSPARPRRLPLLSVLLLPLLG-GTQTAIVFIKQPSSQDALQGRRALLRCEVEAPGPV HVYWLLDGAPVQDTERRFAQGSSLSFAAVD corresponding to amino acids 1-91 of PTK7_HUMAN (SEQ ID NO:595), which also corresponds to amino acids 1-91 of T51958_P5 (SEQ ID NO:633), a bridging amino acid R corresponding to amino acid 92 of T51958_P5 (SEQ ID NO:633), a second amino acid sequence being at least 90% homologous to LQDSGTFQCVARDDVTGEEARSANASFNIKWIEAGPVVLKHPASEAEIQPQTQV corresponding to amino acids 93-146 of PTK7_HUMAN (SEQ ID NO:595), which also corresponds to amino acids 93-146 of T51958_P5 (SEQ ID NO:633), a bridging amino acid T corresponding to amino acid 147 of T51958_P5 (SEQ ID NO:633), a third amino acid sequence being at least 90% homologous to LRCHIDGHPRPTYQWFRDGTPLSDGQS-NHTVSSKERNLTLRPAGPEHSGLYSCCAHSAF corresponding to amino acids 148-206 of PTK7_HUMAN (SEQ ID NO:595), which also corresponds to amino acids 148-206 of T51958_P5 (SEQ ID NO:633), a bridging amino acid G corresponding to amino acid 207 of T51958_P5 (SEQ ID NO:633), a fourth amino acid sequence being at least 90% homologous to QACSSQNFTLSIADESFARVVLAPQDV-VVARYEEAMFHCQFSAQPPPSLQWLFEDETPITN RSRPPHLRRATVFANGSLLLTQVR-PRNAGIYRCIGQGQRGPPIILEATLHLAEIEDMPLFEP RVFTAGSEERVTCLPPKGLPEPSVWWE-HAGVRLPTHGRVYQKGHELVLANIAESDAGVY TCHAANLAGQRRQDVNIT-VATVPSWLKKPQDSQLEEGKPGYLD-CLTQATPKPTVVWYR NQMLISEDSRFEVFKNGTL-RINSVEVYDGTWYRCMSSTPAGSIEAQA corresponding to amino acids 208-494 of PTK7_HUMAN (SEQ ID NO:595), which also corresponds to amino acids 208-494 of T51958_P5 (SEQ ID NO:633), bridging amino acids RV corresponding to amino acid 495-496 of T51958_P5 (SEQ ID NO:633), a fifth amino acid sequence being at least 90% homologous to QVLEKLKFTPP-PQPQQCM corresponding to amino acids 497-514 of PTK7_HUMAN (SEQ ID NO:595), which also corresponds to amino acids 497-514 of T51958_P5 (SEQ ID NO:633), a bridging amino acid E corresponding to amino acid 515 of T51958_P5 (SEQ ID NO:633), a sixth amino acid sequence being at least 90% homologous to FDKEATVPCSAT-GREKPTIKWERADGSSLPEWVTDNAGTL-HFARVTRDDAGNYTCIASN GPQGQIRAH-VQLTVAVFITFKVEPERTTVYQGHTALLQCEAQGDP-KPLIQWKGKDRILDP TKLGPRMHIFQNGSLVIHDVA-PEDSGRYTCIAGNSCNIKHTEAPLYVVD-KPVPEESEGPGS PPPYKMIQTIGLSVGAAVAYIIAV-LGLMFYCKKRCKAKRLQKQPEGEEPEMECLNG corresponding to amino acids 516-751 of PTK7_HUMAN (SEQ ID NO:595), which also corresponds to amino acids 516-751 of T51958_P5 (SEQ ID NO:633), and a seventh amino acid sequence being at least 70%, optionally at least 80%, preferably at least 85%, more preferably at least 90% and most preferably at least 95% homologous to a polypeptide having the sequence EGPWTGRWCPCAGAERP-PAATEGRAPALWKPSGCCWVLELGLPHP (SEQ ID NO:634) corresponding to amino acids 752-796 of T51958_P5 (SEQ ID NO:633), wherein said first amino acid sequence, bridging amino acid, second amino acid sequence, bridging amino acid, third amino acid sequence, bridging amino acid, fourth amino acid sequence, bridging amino acid, fifth amino acid sequence, bridging amino acid, sixth amino acid sequence and seventh amino acid sequence are contiguous and in a sequential order.

B. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRA-PALWKPSGCCWVLELGLPHP (SEQ ID NO:634) of T51958_P5 (SEQ ID NO:633).

2. Comparison Report Between T51958_P5 (SEQ ID NO:633) and Q8NFA5_HUMAN:

A. An isolated chimeric polypeptide encoding for T51958_P5 (SEQ ID NO:633), comprising a first amino acid sequence being at least 90% homologous to MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVATVPSWLKKP-QDS QLEEGKPGYLDCLTQATPKPTVVWYRN-QMLISEDSRFEVFKNGTLRINSVEVYDGTWYR CMSSTPAGSEEAQARVQVLEKLKFTPP-PQPQQCMEFDKEATVPCSATGREKPTIKWERAD GSS-LPEWVTDNAGTLHFARVTRDDAGNYT-CIASNGPQGQIRAHVQLTVAVFITFKVEPER TTVYQGHTALLQCEAQGDPKPLI-QWKGKDRILDPTKLGPRMHIFQNGSLVIHDVAPEDSG RYTCIAGNSCNIKHTEAPLYVVDK-PVPEESEGPGSPPPYKMIQTIGLSVGAAVAYIIAVLGL MFYCKKRCKAKRLQKQPEGEEPEMECLNG corresponding to amino acids 1-751 of Q8NFA5_HUMAN, which also corresponds to amino acids 1-751 of T51958_P5 (SEQ ID NO:633), and a second amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence and second amino acid sequence are contiguous and in a sequential order.

B. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

3. Comparison Report Between T51958_P5 (SEQ ID NO:633) and NP_690622:

A. An isolated chimeric polypeptide encoding for T51958_P5 (SEQ ID NO:633), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKIPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERAD GSSLPEWVTDNAGTLHFARVTRDDAGNYTCIASNGPQGQIRAHVQLTVAVFITFKVEPER TTVYQGHTALLQCEAQGDPKPLIQWKGKDRILDPTKLGPRMHIFQNGSLVIHDVAPEDSG RYTCIAGNSCNIKHTEAPLYVVDKPVPEESEGPGSPPPYKMIQTIGLSVGAAVAYIIAVLGL MFYCKKRCKAKRLQKQPEGEEPEMECLNG corresponding to amino acids 1-751 of NP_690622, which also corresponds to amino acids 1-751 of T51958_P5 (SEQ ID NO:633), and a second amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence and second amino acid sequence are contiguous and in a sequential order.

B. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

4. Comparison Report Between T51958_P5 (SEQ ID NO:633) and NP_002812:

A. An isolated chimeric polypeptide encoding for T51958_P5 (SEQ ID NO:633), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERAD GSSLPEWVTDNAGTLHFARVTRDDAGNYTCIASNGPQGQIRAHVQLTVAVFITFKVEPER TTVYQGHTALLQCEAQGDPKPLIQWKGKDRILDPTKLGPRMHIFQNGSLVIHDVAPEDSG RYTCIAGNSCNIKHTEAPLYVVDKPVPEESEGPGSPPPYKMIQTIGLSVGAAVAYIIAVLGL MFYCKKRCKAKRLQKQPEGEEPEMECLNG corresponding to amino acids 1-751 of NP_002812, which also corresponds to amino acids 1-751 of T51958_P5 (SEQ ID NO:633), and a second amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence and second amino acid sequence are contiguous and in a sequential order.

B. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

5. Comparison Report Between T51958_P5 (SEQ ID NO:633) and Q6IQ54_HUMAN:

A. An isolated chimeric polypeptide encoding for T51958_P5 (SEQ ID NO:633), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDR corresponding to amino acids 1-92 of Q6IQ54_HUMAN, which also corresponds to amino acids 1-92 of T51958_P5 (SEQ ID NO:633), a bridging amino acid L corresponding to amino acid 93 of T51958_P5 (SEQ ID NO:633), a second amino acid sequence being at least 90% homologous to QDSGTFQCVARDDVTGEEARSANASFNIKWIEAGPVVLKHPASEAEIQPQTQVTLRCHID GHPRPTYQWFRDGTPLSDGQSNHTVSSKERNLTLRPAGPEHSGLYSCCAHSAFGQACSSQ NFTLSIADESFARVVLAPQDVVVARYEEAMFHCQFSAQPPPSLQWLFEDETPITNRSRPPH LRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCM EFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNG corresponding to amino acids 94-751 of Q6IQ54_HUMAN, which also corresponds to amino acids 94-751 of T51958_P5 (SEQ ID NO:633), and a third amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence, bridging amino acid, second amino acid sequence and third amino acid sequence are contiguous and in a sequential order.

B. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

6. Comparison Report Between T51958_P5 (SEQ ID NO:633) and NP_690619:

A. An isolated chimeric polypeptide encoding for T51958_P5 (SEQ ID NO:633), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYRCMSSTPAGSIEAQARVQVL corresponding to amino acids 1-499 of NP_690619, which also corresponds to amino acids 1-499 of T51958_P5 (SEQ ID NO:633), a second amino acid sequence being at least 70%, optionally at least 80%, preferably at least 85%, more preferably at least 90% and most preferably at least 95% homologous to a polypeptide having the sequence EKLKFTPPPQPQQCMEFDKEATVPCSATGREKPTIKWERA corresponding to amino acids 500-539 of T51958_P5 (SEQ ID NO:633), a third amino acid sequence being at least 90% homologous to DGSSLPEWVTDNAGTLHFARVTRDDAGNYTCIASNGPQGQIRAHVQLTVAVFITFKVEPE RTTVYQGHTALLQCEAQGDPKPLIQWKGKDRILDPTKLGPRMHIFQNGSLVIHDVAPEDS GRYTCIAGNSCNIKHTEAPLYVVDKPVPEESEGPGSPPPYKMIQTIGLSVGAAVAYIIAVLG LMFYCKKRCKAKRLQKQPEGEEPEMECLNG corresponding to amino acids 500-711 of NP_690619, which also corresponds to amino acids 540-751 of T51958_P5 (SEQ ID NO:633), and a fourth amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence, second amino acid sequence, third amino acid sequence and fourth amino acid sequence are contiguous and in a sequential order.

B. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EKLKFTPPPQPQQCMEFDKEATVPCSATGREKPTIKWERA (SEQ ID NO:619) of T51958_P5 (SEQ ID NO:633).

C. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

7. Comparison Report Between T51958_P5 (SEQ ID NO:633) and Q8NFA8_HUMAN:

A. An isolated chimeric polypeptide encoding for T51958_P5 (SEQ ID NO:633), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEE AMIFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYR CMSSTPAGSEEAQARVQVL corresponding to amino acids 1-499 of Q8NFA8_HUMAN, which also corresponds to amino acids 1-499 of T51958_P5 (SEQ ID NO:633), a second amino acid sequence being at least 70%, optionally at least 80%, preferably at least 85%, more preferably at least 90% and most preferably at least 95% homologous to a polypeptide having the sequence EKLKFTPPPQPQQCMEFDKEATVPCSATGREKPTIKWERA (SEQ ID NO:619) corresponding to amino acids 500-539 of T51958_P5 (SEQ ID NO:633), a third amino acid sequence being at least 90% homologous to DGSSLPEWVTDNAGTLHFARVTRDDAGNYTCIASNGPQGQIRAHVQLTVAVFITFKVEPE RTTVYQGHTALLQCEAQGDPKPLIQWKGKDRILDPTKLGPRMHIFQNGSLVIHDVAPEDS GRYTCIAGNSCNIKHTEAPLYVVDKPVPEESEGPGSPPPYKMIQTIGLSVGAAVAYIIAVLG LMFYCKKRCKAKRLQKQPEGEEPEMECLNG corresponding to amino acids 500-711 of Q8NFA8_HUMAN, which also corresponds to amino acids 540-751 of T51958_P5 (SEQ ID NO:633), and a fourth amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence, second amino acid sequence, third amino acid sequence and fourth amino acid sequence are contiguous and in a sequential order.

B. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EKLKFTPPPQPQQCMEFDKEATVPCSATGREKPTIKWERA (SEQ IDNO:619) of T51958_P5 (SEQ ID NO:633).

C. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

8. Comparison Report Between T51958_P5 (SEQ ID NO:633) and Q8NFA6_HUMAN:

A. An isolated chimeric polypeptide encoding for T51958_P5 (SEQ ID NO:633), comprising a first amino acid sequence being at least 90% homologous to MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVATVPSWLKKPQ-DS QLEEGKPGYLDCLTQATPKPTVVWYRN-QMLISEDSRFEVFKNGTLRINSVEVYDGTWYR CMSSTPAGSEAQARVQVLEKLKFTPP-PQPQQCMEFDKEATVPCSATGREKPTIKWERAD GSSLPEWVTDNAGTLHFARVTRDDAGNYT-CIASNGPQGQIRAHVQLTVAVFITFKVEPER TTVYQGHTALLQCEAQGDPKPLIQWK corresponding to amino acids 1-626 of Q8NFA6_HUMAN, which also corresponds to amino acids 1-626 of T51958_P5 (SEQ ID NO:633), a second amino acid sequence being at least 70%, optionally at least 80%, preferably at least 85%, more preferably at least 90% and most preferably at least 95% homologous to a polypeptide having the sequence GKDRILDPTKLGPRMHIFQNGSLVIHDVAPEDSGRYTCIAGNSCNIKHTEAPLYVV (SEQ ID NO:628) corresponding to amino acids 627-682 of T51958_P5 (SEQ ID NO:633), a third amino acid sequence being at least 90% homologous to DKPVPEESEGPGSPPPYKMIQTIGLSVGAAVAYIIAVLGLMFYCKKRCKAKRLQKQPEGEE PEMECLNG corresponding to amino acids 627-695 of Q8NFA6_HUMAN, which also corresponds to amino acids 683-751 of T51958_P5 (SEQ ID NO:633), and a fourth amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence, second amino acid sequence, third amino acid sequence and fourth amino acid sequence are contiguous and in a sequential order.

B. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence GKDRILDPTKLGPRMHIFQNGSLVIHDVAPEDSGRYTCIAGNSCNIKHTEAPLYVV (SEQ ID NO:628) of T51958_P5 (SEQ ID NO:633).

C. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

9. Comparison Report Between T51958_P5 (SEQ ID NO:633) and NP_690621:

A. An isolated chimeric polypeptide encoding for T51958_P5 (SEQ ID NO:633), comprising a first amino acid sequence being at least 90% homologous to MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVATVPSWLKKP-QDS QLEEGKPGYLDCLTQATPKPTVVWYRN-QMLISEDSRFEVFKNGTLRINSVEVYDGTWYR CMSSTPAGSIEAQARVQVLEKLKFTPP-PQPQQCMEFDKEATVPCSATGREKPTIKWERAD GSSLPEWVTDNAGTLHFARVTRDDAGNYT- CIASNGPQGQIRAHVQLTVAVFITFKVEPER TTVYQGHTALLQCEAQGDPKPLIQWK corresponding to amino acids 1-626 of NP_690621, which also corresponds to amino acids 1-626 of T51958_P5 (SEQ ID NO:633), a second amino acid sequence being at least 70%, optionally at least 80%, preferably at least 85%, more preferably at least 90% and most preferably at least 95% homologous to a polypeptide having the sequence GKDRILDPTKLGPRMHIFQNGSLVIHDVAPEDSGRYTCIAGNSCNIKHTEAPLYVV (SEQ ID NO:628) corresponding to amino acids 627-682 of T51958_P5 (SEQ ID NO:633), a third amino acid sequence being at least 90% homologous to DKPVPEESEGPGSPPPYKMIQTIGLSVGAAVAYIIAVLGLMFYCKKRCKAKRLQKQPEGEEPEMECLNG corresponding to amino acids 627-695 of NP_690621, which also corresponds to amino acids 683-751 of T51958_P5 (SEQ ID NO:633), and a fourth amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence, second amino acid sequence, third amino acid sequence and fourth amino acid sequence are contiguous and in a sequential order.

B. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence GKDRILDPTKLGPRMHIFQNGSLVIHDVAPEDSGRYTCIAGNSCNIKHTEAPLYVV (SEQ ID NO:628) of T51958_P5 (SEQ ID NO:633).

C. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

10. Comparison Report Between T51958_P5 (SEQ ID NO:633) and Q8NFA7_HUMAN:

A. An isolated chimeric polypeptide encoding for T51958_P5 (SEQ ID NO:633), comprising a first amino acid sequence being at least 90% homologous to MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVA corresponding to amino acids 1-409 of Q8NFA7_HUMAN, which also corresponds to amino acids 1-409 of T51958_P5 (SEQ ID NO:633), a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLDCLTQATPKPTVVWYRNQMLISEDSRFEVFKNGTLRINSVEVYDGTWYRCMSSTPAGSEEAQARVQVLEKLKFTPPPQPQQCMEFDKEATVPCSATG REKPTIKWERAD corresponding to amino acids 410-540 of T51958_P5 (SEQ ID NO:633), a third amino acid sequence being at least 90% homologous to GSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNG corresponding to amino acids 411-621 of Q8NFA7_HUMAN, which also corresponds to amino acids 541-751 of T51958_P5 (SEQ ID NO:633), and a fourth amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ ID NO:633), wherein said first amino acid sequence, second amino acid sequence, third amino acid sequence and fourth amino acid sequence are contiguous and in a sequential order.

B. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATG REKPTIKWERAD (SEQ ID NO:621) of T51958_P5 (SEQ ID NO:633).

C. A bridge portion of T51958_P5 (SEQ ID NO:633), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AT, having a structure as follows (numbering according to T51958_P5 (SEQ ID NO:633)): a sequence starting from any of amino acid numbers 409-x to 409; and ending at any of amino acid numbers 410+((n-2)–x), in which x varies from 0 to n-2.

A bridge portion of T51958_P5 (SEQ ID NO:633), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DG, having a structure as follows (numbering according to T51958_P5 (SEQ ID NO:633)): a sequence starting from any of amino acid numbers 540-x to 540; and ending at any of amino acid numbers 541+((n-2)–x), in which x varies from 0 to n-2.

D. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRA- PALWKPSGCCWVLELGLPHP (SEQ ID NO:634) of T51958_P5 (SEQ ID NO:633).

11. Comparison Report Between T51958_P5 (SEQ ID NO:633) and NP_690620:

A. An isolated chimeric polypeptide encoding for T51958_P5 (SEQ ID NO:633), comprising a first amino acid sequence being at least 90% homologous to MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of NP_690620, which also corresponds to amino acids 1-409 of T51958_P5 (SEQ ID NO:633), a second amino acid sequence being at least 70%, optionally at least 80%, preferably at least 85%, more preferably at least 90% and most preferably at least 95% homologous to a polypeptide having the sequence TVPSWLKKPQDSQLEE-GKPGYLDCLTQATPKPTVVWYRNQM-LISEDSRFEVFKNGTLRIN SVEVYDGTWYRC-MSSTPAGSIEAQARVQVLEKLKFTPPPQPQQCMEFD-KEATVPCSATG REKPTIKWERAD (SEQ ID NO:621) corresponding to amino acids 410-540 of T51958_P5 (SEQ ID NO:633), a third amino acid sequence being at least 90% homologous to GSSLPEWVTDNAGTLHFARVTRDDAG-NYTCIASNGPQGQIRAHVQLTVAVFITFKVEPER TTVYQGHTALLQCEAQGDPKPLI-QWKGKDRILDPTKLGPRMHIFQNGSLVIHDVAPEDSG RYTCIAGNSCNIKHTEAPLYVVDK-PVPEESEGPGSPPPYKMIQTIGLSVGAAVAYIIAVLGL MFYCKKRCKAKRLQKQPEGEEPEMECLNG corresponding to amino acids 411-621 of NP_690620, which also corresponds to amino acids 541-751 of T51958_P5 (SEQ ID NO:633), and a fourth amino acid sequence being at least 70%, optionally at least 80%, preferably at least 85%, more preferably at least 90% and most preferably at least 95% homologous to a polypeptide having the sequence EGPWT-GRWCPCAGAERPPAATEGRAPALWKPS-GCCWVLELGLPHP (SEQ ID NO:634) corresponding to amino acids 752-796 of T51958_P5 (SEQ ID NO:633), wherein said first amino acid sequence, second amino acid sequence, third amino acid sequence and fourth amino acid sequence are contiguous and in a sequential order.

B. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLD-CLTQATPKPTVVWYRNQMLISEDSRFEVFKNGTLRIN SVEVYDGTWYRCMSSTPAG-SIEAQARVQVLEKLKFTPPPQPQQC-MEFDKEATVPCSATG REKPTIKWERAD (SEQ ID NO:621) of T51958_P5 (SEQ ID NO:633).

C. A bridge portion of T51958_P5 (SEQ ID NO:633), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AT, having a structure as follows (numbering according to T51958_P5 (SEQ ID NO:633)): a sequence starting from any of amino acid numbers 409-x to 409; and ending at any of amino acid numbers 410+((n-2)–x), in which x varies from 0 to n-2.

A bridge portion of T51958_P5 (SEQ ID NO:633), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise DG, having a structure as follows (numbering according to T51958_P5 (SEQ ID NO:633)): a sequence starting from any of amino acid numbers 540-x to 540; and ending at any of amino acid numbers 541+((n-2)–x), in which x varies from 0 to n-2.

D. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRA-PALWKPSGCCWVLELGLPHP (SEQ ID NO:634) of T51958_P5 (SEQ ID NO:633).

12. Comparison Report Between T51958_P5 (SEQ ID NO:633) and Q86X91_HUMAN:

A. An isolated chimeric polypeptide encoding for T51958_P5 (SEQ ID NO:633), comprising a first amino acid sequence being at least 90% homologous to MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPS-VWWEHAGVRL PTHGRVYQKGHELVLANIAES-DAGVYTCHAANLAGQRRQDVNITVA corresponding to amino acids 1-409 of Q86X91_HUMAN, which also corresponds to amino acids 1-409 of T51958_P5 (SEQ ID NO:633), and a second amino acid sequence being at least 70%, optionally at least 80%, preferably at least 85%, more preferably at least 90% and most preferably at least 95% homologous to a polypeptide having the sequence TVPSWLKKPQDSQLEEGKPGYLD-CLTQATPKPTVVWYRNQMLISEDSRFEVFKNGTLRIN SVEVYDGTWYRCMSSTPAGSEE-AQARVQVLEKLKFTPPPQPQQCMEFD-KEATVPCSATG REKPTIKWERADGSSLPEWVTD-NAGTLHFARVTRDDAGNYTCIASNGPQGQIRAHVQ-LT VAVFITFKVEPERT-TVYQGHTALLQCEAQGDPKPLI-QWKGKDRILDPTKLGPRMHIFQNG SLVIHDVAPEDS-GRYTCIAGNSCNIKHTEAPLYVVDKPVPEESEGPGS-PPPYKMIQTIGLSV GAAVAYIIAVLGLMFYCKKRCK-AKRLQKQPEGEEPEMECLNGEGPWTGR-WCPCAGAER PPAATEGRAPALWKPSGCCWVLELGL-PHP (SEQ I) NO:638) corresponding to amino acids 410-796 of T51958_P5 (SEQ ID NO:633), wherein said first amino acid sequence and second amino acid sequence are contiguous and in a sequential order.

B. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence TVPSWLKKPQDSQLEEGKPGYLDCLTQATPKPTVVWYRNQMLISEDSRFEVFKNGTLRINSVEVYDGTWYRCMSSTPAGSEEAQARVQVLEKLKFTPPPQPQQCMEFDKEATVPCSATG REKPTIKWERADGSSLPEWVTDNAGTLHFARVTRDDAGNYTCIASNGPQGQIAAHVQLT VAVFITFKVEPERTTVYQGHTALLQCEAQGDPKPLIQWKGKDRILDPTKLGPRMHIFQNG SLVIHDVAPEDSGRYTCIAGNSCNIKHTEAPLYVVDKPVPEESEGPGSPPPYKMIQTIGLSV GAAVAYIIAVLGLMFYCKKRCKAKRLQKQPEGEEPEMECLNGEGPWTGRWCPCAGAER PPAATEGRAPALWKPSGCCWVLELGLPHP (SEQ ID NO:638) of T51958_P5 (SEQ ID NO:633).

13. Comparison Report Between T51958_P5 (SEQ ID NO:633) and Q6ZMU3_HUMAN:

A. An isolated chimeric polypeptide encoding for T51958_P5 (SEQ ID NO:633), comprising a first amino acid sequence being at least 70%, optionally at least 80%, preferably at least 85%, more preferably at least 90% and most preferably at least 95%, homologous to a polypeptide having the sequence MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERAD GSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVV corresponding to amino acids 1-682 of T51958_P5 (SEQ ID NO:633), a second amino acid sequence being at least 90% homologous to DKPVPEESEGPGSPPPYKMIQTIGLSVGAAVAYIIAVLGLMFYCKKRCKAKRLQKQPEGEE PEMECLNG corresponding to amino acids 28-96 of Q6ZMU3_HUMAN, which also corresponds to amino acids 683-751 of T51958_P5 (SEQ ID NO:633), and a third amino acid sequence being at least 70%, optionally at least 80%, preferably at least 85%, more preferably at least 90% and most preferably at least 95% homologous to a polypeptide having the sequence EGPWTGRWCPCAGAERPPAATEGRAPALWKPSGCCWVLELGLPHP (SEQ ID NO:634) corresponding to amino acids 752-796 of T51958_P5 (SEQ iID NO:633), wherein said first amino acid sequence, second amino acid sequence and third amino acid sequence are contiguous and in a sequential order.

B. An isolated polypeptide encoding for a head of T51958_P5 (SEQ ID NO:633), comprising a polypeptide being at least 70%, optionally at least about 80%, preferably at least about 85%, more preferably at least about 90% and most preferably at least about 95% homologous to the sequence MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRL PTHGRVYQKGHELVLANIAESDAGVYTCHAANLAGQRRQDVNITVATVPSWLKKPQDS QLEEGKPGYLDCLTQATPKPTVVWYRNQMLISEDSRFEVFKNGTLRINSVEVYDGTWYRCMSSTPAGSEEAQARVQVLEKLKFTPPPQPQQCMEFDKEATVPCSATGREKPTIKWERAD GSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVV of T51958_P5 (SEQ ID NO:633).

C. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence EGPWTGRWCPCAGAERPPAATEGRAPALWKPSGCCWVLELGLPHP (SEQ ID NO:634) of T51958_P5 (SEQ ID NO:633).

14. Comparison Report Between T51958_P5 (SEQ ID NO:633) and Q9NSQ6_HUMAN:

A. An isolated chimeric polypeptide encoding for T51958_P5 (SEQ ID NO:633), comprising a first amino acid sequence being at least 70%, optionally at least 80%, preferably at least 85%, more preferably at least 90% and most preferably at least 95%, homologous to a polypeptide having the sequence MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWW corresponding to amino acids 1-356 of T51958_P5 (SEQ ID NO:633), a second amino acid sequence being at least 90% homologous to EHAGVRLPTHGRVYQKGHELVLANIAESDAGVYTCHAANLAGQRRQDVNITVATVPSW LKKPQDSQLEEGKPGYLDCLTQATPKPTVVWYRNQMLISEDSRFEVF corresponding to amino acids 1-105 of Q9NSQ6_HUMAN, which also corresponds to amino acids 357-461 of T51958_P5 (SEQ ID NO:633), and a third amino acid sequence being at least 70%, optionally at least 80%, preferably at least 85%, more preferably at least 90% and most preferably at least 95% homologous to a polypeptide having the sequence KNGTLRINS-VEVYDGTWYRCMSSTPAGSIEAQARVQV-LEKLKFTPPPQPQQCMEFDKEAT VPCSATGREKPTIK-WERADGSSLPEWVTDNAGTLHFARVTRDDAGNYT-CIASNGPQGQIR AHVQLTVAVFITFKVEPERT-TVYQGHTALLQCEAQGDPKPLI-QWKGKDRILDPTKLGPRM HIFQNGSLVIHDVAPEDS-GRYTCIAGNSCNIKHTEAPLYVVDKPVPEESEGPGS-PPPYKMIQ TIGLSVGAAVAYIIAVLGLMFYCKKRCK-AKRLQKQPEGEEPEMECLNGEGPWTGRWCPC AGAERPPAATEGRAPALWKPSGCCWVLELGLPHP (SEQ ID NO:640) corresponding to amino acids 462-796 of T51958_P5 (SEQ ID NO:633), wherein said first amino acid sequence, second amino acid sequence and third amino acid sequence are contiguous and in a sequential order.

B. An isolated polypeptide encoding for a head of T51958_P5 (SEQ ID NO:633), comprising a polypeptide being at least 70%, optionally at least about 80%, preferably at least about 85%, more preferably at least about 90% and most preferably at least about 95% homologous to the sequence MGAARGSPARPRRLPLLSVLLLPLLG-GTQTAIVFIKQPSSQDALQGRRALLRCEVEAPGPV HVYWLLDGAPVQDTERRFAQGSSLS-FAAVDRLQDSGTFQCVARDDVTGEEARSANASFN IKWIEAGPVVLKHPASEAEIQPQTQVTL-RCHIDGHPRPTYQWFRDGTPLSDGQSNHTVSSK ERNLTLRPAGPEHSGLYSCCAHSAF-GQACSSQNFTLSIADESFARVVLAPQDVVVARYEE AMFHCQFSAQPPPSLQWLFEDETPIT-NRSRPPHLRRATVFANGSLLLTQVRPRNAGIYRCI GQGQRGPPIILEATLHLAEIEDM-PLFEPRVFTAGSEERVTCLPPKGLPEPSVWW of T51958_P5 (SEQ ID NO:633).

C. An isolated polypeptide encoding for an edge portion of T51958_P5 (SEQ ID NO:633), comprising an amino acid sequence being at least 70%, optionally at least about 80%, preferably at least about 85%, more preferably at least about 90% and most preferably at least about 95% homologous to the sequence KNGTLRINSVEVYDGTWYRCMSSTPAG-SIEAQARVQVLEKLKFTPPPQPQQCMEFDKEAT VPC-SATGREKPTIKWERADGSSLPEWVTD-NAGTLHFARVTRDDAGNYTCIASNGPQGQIR AHVQLTVAVFITFKVEPERT-TVYQGHTALLQCEAQGDPKPLI-QWKGKDRILDPTKLGPRM HIFQNGSLVIHDVAPEDS-GRYTCIAGNSCNIKHTEAPLYVVDKPVPEESEGPGS-PPPYKMIQ TIGLSVGAAVAYIIAVLGLMFYCKKRCK-AKRLQKQPEGEEPEMECLNGEGPWTGRWCPC AGAERPPAATEGRAPALWKPSGCCWVLELGLPHP (SEQ ID NO:640) of T51958_P5 (SEQ ID NO:633).

The localization of the variant protein was determined according to results from a number of different software programs and analyses, including analyses from SignalP and other specialized programs. The variant protein is believed to be located as follows with regard to the cell: membrane.

Variant protein T51958_P5 (SEQ ID NO:633) also has the following non-silent SNPs (Single Nucleotide Polymorphisms) as listed in Table 452, (given according to their position(s) on the amino acid sequence, with the alternative amino acid(s) listed; the last column indicates whether the SNP is known or not; the presence of known SNPs in variant protein T51958_P5 (SEQ ID NO:633) sequence provides support for the deduced sequence of this variant protein according to the present invention).

TABLE 452

Amino acid mutations

| SNP position(s) on amino acid sequence | Alternative amino acid(s) | Previously known SNP? |
|---|---|---|
| 207 | G -> D | Yes |

The glycosylation sites of variant protein T51958_P5 (SEQ ID NO:633), as compared to the known protein Tyrosine-protein kinase-like 7 precursor, are described in Table 453 (given according to their position(s) on the amino acid sequence in the first column; the second column indicates whether the glycosylation site is present in the variant protein; and the last column indicates whether the position is different on the variant protein).

TABLE 453

Glycosylation site(s)

| Position(s) on known amino acid sequence | Present in variant protein? | Position(s) on variant protein |
|---|---|---|
| 116 | Yes | 116 |
| 175 | Yes | 175 |
| 184 | Yes | 184 |
| 214 | Yes | 214 |
| 268 | Yes | 268 |
| 283 | Yes | 283 |
| 405 | Yes | 405 |
| 463 | Yes | 463 |
| 567 | Yes | 567 |
| 646 | Yes | 646 |

Variant protein T51958_P5 (SEQ ID NO:633) is encoded by the following transcript(s): T51958_T20 (SEQ ID NO:632) and T51958_T5 (SEQ ID NO:631), for which the sequence(s) given at the end of the application.

As noted above, cluster T51958 features 47 segment(s), which were listed in Table 424 above and for which the sequence(s) are given at the end of the application. These segment(s) are portions of nucleic acid sequence(s) which are described herein separately because they are of particular interest. A description of each segment according to the present invention is now provided.

Segment cluster T51958_NO (SEQ ID NO:362) according to the present invention is supported by 34 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T37 (SEQ ID NO:359), T51958_T38 (SEQ ID NO:360), T51958_T40 (SEQ ID NO:361), T51958_T7 (SEQ ID NO:352) and T51958_T8 (SEQ ID NO:353). Table 454 below describes the starting and ending position of this segment on each transcript.

TABLE 454

Segment location on transcripts

| Transcript name | Segment starting position | Segment ending position |
|---|---|---|
| T51958_T1 (SEQ ID NO: 350) | 1 | 300 |
| T51958_T10 (SEQ ID NO: 354) | 1 | 300 |

TABLE 454-continued

Segment location on transcripts

| Transcript name | Segment starting position | Segment ending position |
|---|---|---|
| T51958_T12 (SEQ ID NO: 355) | 1 | 300 |
| T51958_T13 (SEQ ID NO: 356) | 1 | 300 |
| T51958_T17 (SEQ ID NO: 357) | 1 | 300 |
| T51958_T2 (SEQ ID NO: 351) | 1 | 300 |
| T51958_T31 (SEQ ID NO: 358) | 1 | 300 |
| T51958_T37 (SEQ ID NO: 359) | 1 | 300 |
| T51958_T38 (SEQ ID NO: 360) | 1 | 300 |
| T51958_T40 (SEQ ID NO: 361) | 1 | 300 |
| T51958_T7 (SEQ ID NO: 352) | 1 | 300 |
| T51958_T8 (SEQ ID NO: 353) | 1 | 300 |

Segment cluster T51958_N4 (SEQ ID NO:363) according to the present invention is supported by 44 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T37 (SEQ ID NO:359), T51958_T38 (SEQ ID NO:360), T51958_T40 (SEQ ID NO:361), T51958_T7 (SEQ ID NO:352) and T51958_T8 (SEQ ID NO:353). Table 455 below describes the starting and ending position of this segment on each transcript.

TABLE 455

Segment location on transcripts

| Transcript name | Segment starting position | Segment ending position |
|---|---|---|
| T51958_T1 (SEQ ID NO: 350) | 301 | 588 |
| T51958_T10 (SEQ ID NO: 354) | 301 | 588 |
| T51958_T12 (SEQ ID NO: 355) | 301 | 588 |
| T51958_T13 (SEQ ID NO: 356) | 301 | 588 |
| T51958_T17 (SEQ ID NO: 357) | 301 | 588 |
| T51958_T2 (SEQ ID NO: 351) | 301 | 588 |
| T51958_T31 (SEQ ID NO: 358) | 301 | 588 |
| T51958_T37 (SEQ ID NO: 359) | 301 | 588 |
| T51958_T38 (SEQ ID NO: 360) | 301 | 588 |
| T51958_T40 (SEQ ID NO: 361) | 301 | 588 |
| T51958_T7 (SEQ ID NO: 352) | 301 | 588 |
| T51958_T8 (SEQ ID NO: 353) | 301 | 588 |

Segment cluster T51958_N5 (SEQ ID NO:364) according to the present invention is supported by 4 libraries. The number of libraries was determined as previously described. This segment can be found in the following transcript(s): T51958_T40 (SEQ ID NO:361). Table 456 below describes the starting and ending position of this segment on each transcript.

TABLE 456

Segment location on transcripts

| Transcript name | Segment starting position | Segment ending position |
|---|---|---|
| T51958_T40 (SEQ ID NO: 361) | 589 | 985 |

Segment cluster T51958_N10 (SEQ ID NO:365) according to the present invention is supported by 40 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T17 (SEQ ID NO:357), T51958_T2 (SEQ ID NO:351), T51958_T31 (SEQ ID NO:358), T51958_T37 (SEQ ID NO:359), T51958_T38 (SEQ ID NO:360) and T51958_T8 (SEQ ID NO:353). Table 457 below describes the starting and ending position of this segment on each transcript.

TABLE 457

Segment location on transcripts

| Transcript name | Segment starting position | Segment ending position |
|---|---|---|
| T51958_T1 (SEQ ID NO: 350) | 692 | 882 |
| T51958_T10 (SEQ ID NO: 354) | 692 | 882 |
| T51958_T12 (SEQ ID NO: 355) | 692 | 882 |
| T51958_T17 (SEQ ID NO: 357) | 692 | 882 |
| T51958_T2 (SEQ ID NO: 351) | 692 | 882 |
| T51958_T31 (SEQ ID NO: 358) | 692 | 882 |
| T51958_T37 (SEQ ID NO: 359) | 692 | 882 |
| T51958_T38 (SEQ ID NO: 360) | 692 | 882 |
| T51958_T8 (SEQ ID NO: 353) | 692 | 882 |

Segment cluster T51958_N12 (SEQ ID NO:366) according to the present invention is supported by 40 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T37 (SEQ ID NO:359), T51958_T38 (SEQ ID NO:360), T51958_T7 (SEQ ID NO:352) and T51958_T8 (SEQ ID NO:353). Table 458 below describes the starting and ending position of this segment on each transcript.

TABLE 458

Segment location on transcripts

| Transcript name | Segment starting position | Segment ending position |
|---|---|---|
| T51958_T1 (SEQ ID NO: 350) | 883 | 1033 |
| T51958_T10 (SEQ ID NO: 354) | 883 | 1033 |
| T51958_T12 (SEQ ID NO: 355) | 883 | 1033 |
| T51958_T13 (SEQ ID NO: 356) | 692 | 842 |
| T51958_T17 (SEQ ID NO: 357) | 883 | 1033 |
| T51958_T2 (SEQ ID NO: 351) | 973 | 1123 |
| T51958_T31 (SEQ ID NO: 358) | 883 | 1033 |
| T51958_T37 (SEQ ID NO: 359) | 883 | 1033 |
| T51958_T38 (SEQ ID NO: 360) | 883 | 1033 |
| T51958_T7 (SEQ ID NO: 352) | 692 | 842 |
| T51958_T8 (SEQ ID NO: 353) | 883 | 1033 |

Segment cluster T51958_N14 (SEQ ID NO:367) according to the present invention is supported by 39 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T37 (SEQ ID NO:359), T51958_T38 (SEQ ID NO:360), T51958_T7 (SEQ ID NO:352) and T51958_T8 (SEQ ID NO:353). Table 459 below describes the starting and ending position of this segment on each transcript.

TABLE 459

Segment location on transcripts

| Transcript name | Segment starting position | Segment ending position |
|---|---|---|
| T51958_T1 (SEQ ID NO: 350) | 1034 | 1182 |
| T51958_T10 (SEQ ID NO: 354) | 1034 | 1182 |
| T51958_T12 (SEQ ID NO: 355) | 1034 | 1182 |
| T51958_T13 (SEQ ID NO: 356) | 843 | 991 |
| T51958_T17 (SEQ ID NO: 357) | 1034 | 1182 |
| T51958_T2 (SEQ ID NO: 351) | 1124 | 1272 |
| T51958_T31 (SEQ ID NO: 358) | 1034 | 1182 |
| T51958_T37 (SEQ ID NO: 359) | 1034 | 1182 |
| T51958_T38 (SEQ ID NO: 360) | 1034 | 1182 |
| T51958_T7 (SEQ ID NO: 352) | 843 | 991 |
| T51958_T8 (SEQ ID NO: 353) | 1034 | 1182 |

Segment cluster T51958_N17 (SEQ ID NO:368) according to the present invention is supported by 42 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T37 (SEQ ID NO:359), T51958_T38 (SEQ ID NO:360), T51958_T7 (SEQ ID NO:352) and T51958_T8 (SEQ ID NO:353). Table 460 below describes the starting and ending position of this segment on each transcript.

TABLE 460

Segment location on transcripts

| Transcript name | Segment starting position | Segment ending position |
|---|---|---|
| T51958_T1 (SEQ ID NO: 350) | 1251 | 1449 |
| T51958_T10 (SEQ ID NO: 354) | 1251 | 1449 |
| T51958_T12 (SEQ ID NO: 355) | 1251 | 1449 |
| T51958_T13 (SEQ ID NO: 356) | 1060 | 1258 |
| T51958_T17 (SEQ ID NO: 357) | 1251 | 1449 |
| T51958_T2 (SEQ ID NO: 351) | 1341 | 1539 |
| T51958_T31 (SEQ ID NO: 358) | 1251 | 1449 |
| T51958_T37 (SEQ ID NO: 359) | 1251 | 1449 |
| T51958_T38 (SEQ ID NO: 360) | 1251 | 1449 |
| T51958_T7 (SEQ ID NO: 352) | 1060 | 1258 |
| T51958_T8 (SEQ ID NO: 353) | 1251 | 1449 |

Segment cluster T51958_N18 (SEQ ID NO:369) according to the present invention is supported by 5 libraries. The number of libraries was determined as previously described. This segment can be found in the following transcript(s): T51958_T37 (SEQ ID NO:359) and T51958_T38 (SEQ ID NO:360). Table 461 below describes the starting and ending position of this segment on each transcript.

TABLE 461

Segment location on transcripts

| Transcript name | Segment starting position | Segment ending position |
|---|---|---|
| T51958_T37 (SEQ ID NO: 359) | 1450 | 2482 |
| T51958_T38 (SEQ ID NO: 360) | 1450 | 2800 |

Segment cluster T51958_N21 (SEQ ID NO:370) according to the present invention is supported by 42 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T2 (SEQ ID NO:351), T51958_T31 (SEQ ID NO:358), T51958_T7 (SEQ ID NO:352) and T51958_T8 (SEQ ID NO:353). Table 462 below describes the starting and ending position of this segment on each transcript.

TABLE 462

Segment location on transcripts

| Transcript name | Segment starting position | Segment ending position |
|---|---|---|
| T51958_T1 (SEQ ID NO: 350) | 1450 | 1583 |
| T51958_T10 (SEQ ID NO: 354) | 1450 | 1583 |
| T51958_T12 (SEQ ID NO: 355) | 1450 | 1583 |
| T51958_T13 (SEQ ID NO: 356) | 1259 | 1392 |
| T51958_T2 (SEQ ID NO: 351) | 1540 | 1673 |
| T51958_T31 (SEQ ID NO: 358) | 1450 | 1583 |
| T51958_T7 (SEQ ID NO: 352) | 1259 | 1392 |
| T51958_T8 (SEQ ID NO: 353) | 1450 | 1583 |

Segment cluster T51958_N24 (SEQ ID NO:371) according to the present invention is supported by 44 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T2 (SEQ ID NO:351), T51958_T31 (SEQ ID NO:358), T51958_T7 (SEQ ID NO:352) and T51958_T8 (SEQ ID NO:353). Table 463 below describes the starting and ending position of this segment on each transcript.

TABLE 463

Segment location on transcripts

| Transcript name | Segment starting position | Segment ending position |
|---|---|---|
| T51958_T1 (SEQ ID NO: 350) | 1599 | 1719 |
| T51958_T10 (SEQ ID NO: 354) | 1599 | 1719 |
| T51958_T12 (SEQ ID NO: 355) | 1599 | 1719 |
| T51958_T13 (SEQ ID NO: 356) | 1408 | 1528 |
| T51958_T2 (SEQ ID NO: 351) | 1689 | 1809 |
| T51958_T31 (SEQ ID NO: 358) | 1599 | 1719 |
| T51958_T7 (SEQ ID NO: 352) | 1408 | 1528 |
| T51958_T8 (SEQ ID NO: 353) | 1599 | 1719 |

Segment cluster T51958_N26 (SEQ ID NO:372) according to the present invention is supported by 45 libraries. The number of libraries was determined as previously described This segment can be found in the following transcript(s): T51958_T1 (SEQ ID NO:350), T51958_T18 (SEQ ID NO:354), T51958_T12 (SEQ ID NO:355), T51958_T13 (SEQ ID NO:356), T51958_T2 (SEQ ID NO:351), T51958_T31 (SEQ ID NO:358), T51958_T7 (SEQ ID NO:352) and T51958_T8 (SEQ ID NO:353). Table 464 below describes the starting and ending position of this segment on each transcript.

TABLE 464

Segment location on transcripts

| Transcript name | Segment starting position | Segment ending position |
|---|---|---|
| T51958_T1 (SEQ ID NO: 350) | 1720 | 1839 |
| T51958_T10 (SEQ ID NO: 354) | 1720 | 1839 |
| T51958_T12 (SEQ ID NO: 355) | 1720 | 1839 |
| T51958_T13 (SEQ ID NO: 356) | 1529 | 1648 |
| T51958_T2 (SEQ ID NO: 351) | 1810 | 1929 |
| T51958_T31 (SEQ ID NO: 358) | 1720 | 1839 |
| T51958_T7 (SEQ ID NO: 352) | 1529 | 1648 |
| T51958_T8 (SEQ ID NO: 353) | 1720 | 1839 |

Segment cluster T51958_N30 (SEQ ID NO:373) according to the present invention is supported by 52 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 465 below describes the starting and ending position of this segment on each transcript.

TABLE 465

Segment location on transcripts

| Transcript name | Segment starting position | Segment ending position |
|---|---|---|
| T51958_T1 (SEQ ID NO: 350) | 1840 | 1989 |
| T51958_T10 (SEQ ID NO: 354) | 1840 | 1989 |
| T51958_T12 (SEQ ID NO: 355) | 1840 | 1989 |
| T51958_T13 (SEQ ID NO: 356) | 1649 | 1798 |
| T51958_T17 (SEQ ID NO: 357) | 1450 | 1599 |
| T51958_T2 (SEQ ID NO: 351) | 1930 | 2079 |
| T51958_T31 (SEQ ID NO: 358) | 1840 | 1989 |
| T51958_T7 (SEQ ID NO: 352) | 1649 | 1798 |
| T51958_T8 (SEQ ID NO: 353) | 1840 | 1989 |

Segment cluster T51958_N37 (SEQ ID NO:374) according to the present invention is supported by 20 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T31 (SEQ ID NO:358) and T51958_T8 (SEQ ID NO:353). Table 466 below describes the starting and ending position of this segment on each transcript.

TABLE 466

Segment location on transcripts

| Transcript name | Segment starting position | Segment ending position |
|---|---|---|
| T51958_T1 (SEQ ID NO: 350) | 2269 | 3385 |
| T51958_T10 (SEQ ID NO: 354) | 2269 | 3385 |
| T51958_T12 (SEQ ID NO: 355) | 2269 | 3385 |
| T51958_T31 (SEQ ID NO: 358) | 2269 | 3385 |
| T51958_T8 (SEQ ID NO: 353) | 2253 | 3369 |

Segment cluster T51958_N42 (SEQ ID NO:375) according to the present invention is supported by 15 libraries. The number of libraries was determined as previously described. This segment can be found in the following transcript(s): T51958_T12 (SEQ ID NO:355). Table 467 below describes the starting and ending position of this segment on each transcript.

TABLE 467

Segment location on transcripts

| Transcript name | Segment starting position | Segment ending position |
|---|---|---|
| T51958_T12 (SEQ ID NO: 355) | 3590 | 4419 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 468.

TABLE 468

Oligonucleotides related to this segment

| Oligonucleotide name | Overexpressed in cancers | Chip reference |
|---|---|---|
| T51958_0_0_50903 (SEQ ID NO: 517) | colorectal cancer | Colon |
| T51958_0_0_50903 (SEQ ID NO: 517) | lung malignant tumors | LUN |

The sequence of T51958_0_0_50903 (SEQ ID NO:517) oligonucleotide is as follows:

CCCATGGTGGCCAGAGTGTCAGGTCTCATCGTGACGCTCTTGTCCTCCTC

Segment cluster T51958_N48 (SEQ ID NO:376) according to the present invention is supported by 5 libraries. The number of libraries was determined as previously described. This segment can be found in the following transcript(s): T51958_T31 (SEQ ID NO:358). Table 469 below describes the starting and ending position of this segment on each transcript.

TABLE 469

Segment location on transcripts

| Transcript name | Segment starting position | Segment ending position |
|---|---|---|
| T51958_T31 (SEQ ID NO: 358) | 3746 | 4336 | segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 470 below describes the starting and ending position of this segment on each transcript.

TABLE 470

Segment location on transcripts

| Transcript name | Segment starting position | Segment ending position |
|---|---|---|
| T51958_T1 (SEQ ID NO: 350) | 3766 | 3978 |
| T51958_T10 (SEQ ID NO: 354) | 3768 | 3980 |
| T51958_T12 (SEQ ID NO: 355) | 4596 | 4808 |
| T51958_T13 (SEQ ID NO: 356) | 2453 | 2665 |
| T51958_T17 (SEQ ID NO: 357) | 2259 | 2471 |
| T51958_T2 (SEQ ID NO: 351) | 2739 | 2951 |
| T51958_T31 (SEQ ID NO: 358) | 4359 | 4571 |
| T51958_T7 (SEQ ID NO: 352) | 2458 | 2670 |
| T51958_T8 (SEQ ID NO: 353) | 3750 | 3962 |

Segment cluster T51958_N52 (SEQ ID NO:378) according to the present invention is supported by 4 libraries. The number of libraries was determined as previously described. This segment can be found in the following transcript(s): T51958_T31 (SEQ ID NO:358). Table 471 below describes the starting and ending position of this segment on each transcript.

TABLE 471

Segment location on transcripts

| Transcript name | Segment starting position | Segment ending position |
|---|---|---|
| T51958_T31 (SEQ ID NO: 358) | 4572 | 5047 |

Segment cluster T51958_N53 (SEQ ID NO:379) according to the present invention is supported by 2 libraries. The number of libraries was determined as previously described. This segment can be found in the following transcript(s): T51958_T31 (SEQ ID NO:358). Table 472 below describes the starting and ending position of this segment on each transcript.

TABLE 472

Segment location on transcripts

| Transcript name | Segment starting position | Segment ending position |
|---|---|---|
| T51958_T31 (SEQ ID NO: 358) | 5048 | 5335 |

Segment cluster T51958_N61 (SEQ ID NO:380) according to the present invention is supported by 94 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T7 (SEQ ID NO:352) and T51958_T8 (SEQ ID NO:353). Table 473 below describes the starting and ending position of this segment on each transcript.

TABLE 473

Segment location on transcripts

| Transcript name | Segment starting position | Segment ending position |
|---|---|---|
| T51958_T1 (SEQ ID NO: 350) | 4060 | 4211 |
| T51958_T10 (SEQ ID NO: 354) | 4062 | 4213 |
| T51958_T12 (SEQ ID NO: 355) | 4890 | 5041 |
| T51958_T13 (SEQ ID NO: 356) | 2747 | 2898 |
| T51958_T17 (SEQ ID NO: 357) | 2553 | 2704 |
| T51958_T2 (SEQ ID NO: 351) | 3033 | 3184 |
| T51958_T7 (SEQ ID NO: 352) | 2752 | 2903 |
| T51958_T8 (SEQ ID NO: 353) | 4044 | 4195 |

Segment cluster T51958_N64 (SEQ ID NO:381) according to the present invention is supported by 99 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T7 (SEQ ID NO:352) and T51958_T8 (SEQ ID NO:353). Table 474 below describes the starting and ending position of this segment on each transcript.

TABLE 474

Segment location on transcripts

| Transcript name | Segment starting position | Segment ending position |
|---|---|---|
| T51958_T1 (SEQ ID NO: 350) | 4212 | 4333 |
| T51958_T10 (SEQ ID NO: 354) | 4214 | 4335 |
| T51958_T12 (SEQ ID NO: 355) | 5042 | 5163 |
| T51958_T13 (SEQ ID NO: 356) | 2899 | 3020 |
| T51958_T17 (SEQ ID NO: 357) | 2705 | 2826 |
| T51958_T2 (SEQ ID NO: 351) | 3185 | 3306 |
| T51958_T7 (SEQ ID NO: 352) | 2904 | 3025 |
| T51958_T8 (SEQ ID NO: 353) | 4196 | 4317 |

Segment cluster T51958_N68 (SEQ ID NO:382) according to the present invention is supported by 215 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T7 (SEQ ID NO:352) and T51958_T8 (SEQ ID NO:353). Table 475 below describes the starting and ending position of this segment on each transcript.

TABLE 475

Segment location on transcripts

| Transcript name | Segment starting position | Segment ending position |
|---|---|---|
| T51958_T1 (SEQ ID NO: 350) | 4391 | 5090 |
| T51958_T10 (SEQ ID NO: 354) | 4393 | 5092 |
| T51958_T12 (SEQ ID NO: 355) | 5221 | 5920 |
| T51958_T13 (SEQ ID NO: 356) | 3078 | 3777 |
| T51958_T17 (SEQ ID NO: 357) | 2884 | 3583 |
| T51958_T2 (SEQ ID NO: 351) | 3364 | 4063 |
| T51958_T7 (SEQ ID NO: 352) | 3083 | 3782 |
| T51958_T8 (SEQ ID NO: 353) | 4375 | 5074 |

Segment cluster T51958_N72 (SEQ ID NO:383) according to the present invention is supported by 133 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T7 (SEQ ID NO:352) and T51958_T8 (SEQ ID NO:353). Table 476 below describes the starting and ending position of this segment on each transcript.

TABLE 476

Segment location on transcripts

| Transcript name | Segment starting position | Segment ending position |
|---|---|---|
| T51958_T1 (SEQ ID NO: 350) | 5137 | 5390 |
| T51958_T10 (SEQ ID NO: 354) | 5139 | 5392 |
| T51958_T12 (SEQ ID NO: 355) | 5967 | 6220 |
| T51958_T13 (SEQ ID NO: 356) | 3824 | 4077 |
| T51958_T17 (SEQ ID NO: 357) | 3630 | 3883 |
| T51958_T2 (SEQ ID NO: 351) | 4110 | 4363 |
| T51958_T7 (SEQ ID NO: 352) | 3829 | 4082 |
| T51958_T8 (SEQ ID NO: 353) | 5121 | 5374 |

According to an optional embodiment of the present invention, short segments related to the above cluster are also provided. These segments are up to about 120 bp in length, and so are included in a separate description.

Segment cluster T51958_N7 (SEQ ID NO:384) according to the present invention is supported by 37 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T37 (SEQ ID NO:359), T51958_T38 (SEQ ID NO:360), T51958_T7 (SEQ ID NO:352) and T51958_T8 (SEQ ID NO:353). Table 477 below describes the starting and ending position of this segment on each transcript.

TABLE 477

Segment location on transcripts

| Transcript name | Segment starting position | Segment ending position |
|---|---|---|
| T51958_T1 (SEQ ID NO: 350) | 589 | 691 |
| T51958_T10 (SEQ ID NO: 354) | 589 | 691 |
| T51958_T12 (SEQ ID NO: 355) | 589 | 691 |
| T51958_T13 (SEQ ID NO: 356) | 589 | 691 |
| T51958_T17 (SEQ ID NO: 357) | 589 | 691 |
| T51958_T2 (SEQ ID NO: 351) | 589 | 691 |
| T51958_T31 (SEQ ID NO: 358) | 589 | 691 |
| T51958_T37 (SEQ ID NO: 359) | 589 | 691 |
| T51958_T38 (SEQ ID NO: 360) | 589 | 691 |
| T51958_T7 (SEQ ID NO: 352) | 589 | 691 |
| T51958_T8 (SEQ ID NO: 353) | 589 | 691 |

Segment cluster T51958_N11 (SEQ ID NO:385) according to the present invention is supported by 2 libraries. The number of libraries was determined as previously described. This segment can be found in the following transcript(s): T51958_T2 (SEQ ID NO:351). Table 478 below describes the starting and ending position of this segment on each transcript.

TABLE 478

Segment location on transcripts

| Transcript name | Segment starting position | Segment ending position |
|---|---|---|
| T51958_T2 (SEQ ID NO: 351) | 883 | 972 |

Segment cluster T51958_N16 (SEQ ID NO:386) according to the present invention is supported by 37 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T37 (SEQ ID NO:359), T51958_T38 (SEQ ID NO:360), T51958_T7 (SEQ ID NO:352) and T51958_T8 (SEQ ID NO:353). Table 479 below describes the starting and ending position of this segment on each transcript.

TABLE 479

Segment location on transcripts

| Transcript name | Segment starting position | Segment ending position |
|---|---|---|
| T51958_T1 (SEQ ID NO: 350) | 1183 | 1250 |
| T51958_T10 (SEQ ID NO: 354) | 1183 | 1250 |
| T51958_T12 (SEQ ID NO: 355) | 1183 | 1250 |
| T51958_T13 (SEQ ID NO: 356) | 992 | 1059 |
| T51958_T17 (SEQ ID NO: 357) | 1183 | 1250 |
| T51958_T2 (SEQ ID NO: 351) | 1273 | 1340 |
| T51958_T31 (SEQ ID NO: 358) | 1183 | 1250 |
| T51958_T37 (SEQ ID NO: 359) | 1183 | 1250 |
| T51958_T38 (SEQ ID NO: 360) | 1183 | 1250 |
| T51958_T7 (SEQ ID NO: 352) | 992 | 1059 |
| T51958_T8 (SEQ ID NO: 353) | 1183 | 1250 |

Segment cluster T51958_N23 (SEQ ID NO:387) according to the present invention is supported by 40 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T2 (SEQ ID NO:351), T51958_T31 (SEQ ID NO:358), T51958_T7 (SEQ ID NO:352) and T51958_T8 (SEQ ID NO:353). Table 480 below describes the starting and ending position of this segment on each transcript.

TABLE 480

Segment location on transcripts

| Transcript name | Segment starting position | Segment ending position |
|---|---|---|
| T51958_T1 (SEQ ID NO: 350) | 1584 | 1598 |
| T51958_T10 (SEQ ID NO: 354) | 1584 | 1598 |
| T51958_T12 (SEQ ID NO: 355) | 1584 | 1598 |
| T51958_T13 (SEQ ID NO: 356) | 1393 | 1407 |
| T51958_T2 (SEQ ID NO: 351) | 1674 | 1688 |
| T51958_T31 (SEQ ID NO: 358) | 1584 | 1598 |
| T51958_T7 (SEQ ID NO: 352) | 1393 | 1407 |
| T51958_T8 (SEQ ID NO: 353) | 1584 | 1598 |

Segment cluster T51958_N32 (SEQ ID NO:388) according to the present invention is supported by 57 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 481 below describes the starting and ending position of this segment on each transcript.

TABLE 481

Segment location on transcripts

| Transcript name | Segment starting position | Segment ending position |
|---|---|---|
| T51958_T1 (SEQ ID NO: 350) | 1990 | 2100 |
| T51958_T10 (SEQ ID NO: 354) | 1990 | 2100 |
| T51958_T12 (SEQ ID NO: 355) | 1990 | 2100 |
| T51958_T13 (SEQ ID NO: 356) | 1799 | 1909 |
| T51958_T17 (SEQ ID NO: 357) | 1600 | 1710 |
| T51958_T2 (SEQ ID NO: 351) | 2080 | 2190 |
| T51958_T31 (SEQ ID NO: 358) | 1990 | 2100 |
| T51958_T7 (SEQ ID NO: 352) | 1799 | 1909 |
| T51958_T8 (SEQ ID NO: 353) | 1990 | 2100 |

Segment cluster T51958_N33 (SEQ ID NO:389) according to the present invention is supported by 48 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358T51958_T7 (SEQ ID NO:352) and T51958_T8 (SEQ ID NO:353). Table 482 below describes the starting and ending position of this segment on each transcript.

TABLE 482

Segment location on transcripts

| Transcript name | Segment starting position | Segment ending position |
|---|---|---|
| T51958_T1 (SEQ ID NO: 350) | 2101 | 2140 |
| T51958_T10 (SEQ ID NO: 354) | 2101 | 2140 |
| T51958_T12 (SEQ ID NO: 355) | 2101 | 2140 |
| T51958_T13 (SEQ ID NO: 356) | 1910 | 1949 |
| T51958_T17 (SEQ ID NO: 357) | 1711 | 1750 |
| T51958_T2 (SEQ ID NO: 351) | 2191 | 2230 |
| T51958_T31 (SEQ ID NO: 358) | 2101 | 2140 |
| T51958_T7 (SEQ ID NO: 352) | 1910 | 1949 |
| T51958_T8 (SEQ ID NO: 353) | 2101 | 2140 |

Segment cluster T51958_N35 (SEQ ID NO:390) according to the present invention is supported by 45 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358) and T51958_T7 (SEQ ID NO:352). Table 483 below describes the starting and ending position of this segment on each transcript.

TABLE 483

Segment location on transcripts

| Transcript name | Segment starting position | Segment ending position |
|---|---|---|
| T51958_T1 (SEQ ID NO: 350) | 2141 | 2156 |
| T51958_T10 (SEQ ID NO: 354) | 2141 | 2156 |
| T51958_T12 (SEQ ID NO: 355) | 2141 | 2156 |
| T51958_T13 (SEQ ID NO: 356) | 1950 | 1965 |
| T51958_T17 (SEQ ID NO: 357) | 1751 | 1766 |
| T51958_T2 (SEQ ID NO: 351) | 2231 | 2246 |
| T51958_T31 (SEQ ID NO: 358) | 2141 | 2156 |
| T51958_T7 (SEQ ID NO: 352) | 1950 | 1965 |

Segment cluster T51958_N36 (SEQ ID NO:391) according to the present invention is supported by 52 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 484 below describes the starting and ending position of this segment on each transcript.

TABLE 484

Segment location on transcripts

| Transcript name | Segment starting position | Segment ending position |
|---|---|---|
| T51958_T1 (SEQ ID NO: 350) | 2157 | 2268 |
| T51958_T10 (SEQ ID NO: 354) | 2157 | 2268 |
| T51958_T12 (SEQ ID NO: 355) | 2157 | 2268 |
| T51958_T13 (SEQ ID NO: 356) | 1966 | 2077 |
| T51958_T17 (SEQ ID NO: 357) | 1767 | 1878 |
| T51958_T2 (SEQ ID NO: 351) | 2247 | 2358 |
| T51958_T31 (SEQ ID NO: 358) | 2157 | 2268 |
| T51958_T7 (SEQ ID NO: 352) | 1966 | 2077 |
| T51958_T8 (SEQ ID NO: 353) | 2141 | 2252 |

Segment cluster T51958_N38 (SEQ ID NO:392) according to the present invention is supported by 54 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 485 below describes the starting and ending position of this segment on each transcript.

TABLE 485

Segment location on transcripts

| Transcript name | Segment starting position | Segment ending position |
|---|---|---|
| T51958_T1 (SEQ ID NO: 350) | 3386 | 3390 |
| T51958_T10 (SEQ ID NO: 354) | 3386 | 3390 |
| T51958_T12 (SEQ ID NO: 355) | 3386 | 3390 |
| T51958_T17 (SEQ ID NO: 357) | 1879 | 1883 |
| T51958_T2 (SEQ ID NO: 351) | 2359 | 2363 |
| T51958_T31 (SEQ ID NO: 358) | 3386 | 3390 |
| T51958_T7 (SEQ ID NO: 352) | 2078 | 2082 |
| T51958_T8 (SEQ ID NO: 353) | 3370 | 3374 |

Segment cluster T51958_N39 (SEQ ID NO:393) according to the present invention is supported by 69 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 486 below describes the starting and ending position of this segment on each transcript.

TABLE 486

Segment location on transcripts

| Transcript name | Segment starting position | Segment ending position |
|---|---|---|
| T51958_T1 (SEQ ID NO: 350) | 3391 | 3509 |
| T51958_T10 (SEQ ID NO: 354) | 3391 | 3509 |
| T51958_T12 (SEQ ID NO: 355) | 3391 | 3509 |
| T51958_T13 (SEQ ID NO: 356) | 2078 | 2196 |
| T51958_T17 (SEQ ID NO: 357) | 1884 | 2002 |
| T51958_T2 (SEQ ID NO: 351) | 2364 | 2482 |
| T51958_T31 (SEQ ID NO: 358) | 3391 | 3509 |
| T51958_T7 (SEQ ID NO: 352) | 2083 | 2201 |
| T51958_T8 (SEQ ID NO: 353) | 3375 | 3493 |

Segment cluster T51958_N40 (SEQ ID NO:394) according to the present invention is supported by 74 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 487 below describes the starting and ending position of this segment on each transcript.

TABLE 487

Segment location on transcripts

| Transcript name | Segment starting position | Segment ending position |
|---|---|---|
| T51958_T1 (SEQ ID NO: 350) | 3510 | 3573 |
| T51958_T10 (SEQ ID NO: 354) | 3510 | 3573 |
| T51958_T12 (SEQ ID NO: 355) | 3510 | 3573 |
| T51958_T13 (SEQ ID NO: 356) | 2197 | 2260 |
| T51958_T17 (SEQ ID NO: 357) | 2003 | 2066 |
| T51958_T2 (SEQ ID NO: 351) | 2483 | 2546 |
| T51958_T31 (SEQ ID NO: 358) | 3510 | 3573 |
| T51958_T7 (SEQ ID NO: 352) | 2202 | 2265 |
| T51958_T8 (SEQ ID NO: 353) | 3494 | 3557 |

Segment cluster T51958_N41 (SEQ ID NO:395) according to the present invention is supported by 74 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 488 below describes the starting and ending position of this segment on each transcript.

TABLE 488

Segment location on transcripts

| Transcript name | Segment starting position | Segment ending position |
|---|---|---|
| T51958_T1 (SEQ ID NO: 350) | 3574 | 3589 |
| T51958_T10 (SEQ ID NO: 354) | 3574 | 3589 |
| T51958_T12 (SEQ ID NO: 355) | 3574 | 3589 |
| T51958_T13 (SEQ ID NO: 356) | 2261 | 2276 |
| T51958_T17 (SEQ ID NO: 357) | 2067 | 2082 |
| T51958_T2 (SEQ ID NO: 351) | 2547 | 2562 |
| T51958_T31 (SEQ ID NO: 358) | 3574 | 3589 |
| T51958_T7 (SEQ ID NO: 352) | 2266 | 2281 |
| T51958_T8 (SEQ ID NO: 353) | 3558 | 3573 |

Segment cluster T51958_N43 (SEQ ID NO:396) according to the present invention is supported by 80 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 489 below describes the starting and ending position of this segment on each transcript.

TABLE 489

Segment location on transcripts

| Transcript name | Segment starting position | Segment ending position |
|---|---|---|
| T51958_T1 (SEQ ID NO: 350) | 3590 | 3664 |
| T51958_T10 (SEQ ID NO: 354) | 3590 | 3664 |
| T51958_T12 (SEQ ID NO: 355) | 4420 | 4494 |
| T51958_T13 (SEQ ID NO: 356) | 2277 | 2351 |
| T51958_T17 (SEQ ID NO: 357) | 2083 | 2157 |
| T51958_T2 (SEQ ID NO: 351) | 2563 | 2637 |
| T51958_T31 (SEQ ID NO: 358) | 3590 | 3664 |
| T51958_T7 (SEQ ID NO: 352) | 2282 | 2356 |
| T51958_T8 (SEQ ID NO: 353) | 3574 | 3648 |

Segment cluster T51958_N44 (SEQ ID NO:397) according to the present invention is supported by 85 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 490 below describes the starting and ending position of this segment on each transcript.

TABLE 490

Segment location on transcripts

| Transcript name | Segment starting position | Segment ending position |
|---|---|---|
| T51958_T1 (SEQ ID NO: 350) | 3665 | 3694 |
| T51958_T10 (SEQ ID NO: 354) | 3665 | 3694 |
| T51958_T12 (SEQ ID NO: 355) | 4495 | 4524 |
| T51958_T13 (SEQ ID NO: 356) | 2352 | 2381 |
| T51958_T17 (SEQ ID NO: 357) | 2158 | 2187 |

TABLE 490-continued

Segment location on transcripts

| Transcript name | Segment starting position | Segment ending position |
|---|---|---|
| T51958_T2 (SEQ ID NO: 351) | 2638 | 2667 |
| T51958_T31 (SEQ ID NO: 358) | 3665 | 3694 |
| T51958_T7 (SEQ ID NO: 352) | 2357 | 2386 |
| T51958_T8 (SEQ ID NO: 353) | 3649 | 3678 |

Segment cluster T51958_N45 (SEQ ID NO:398) according to the present invention is supported by 84 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358T51958_T7 (SEQ ID NO:352) and T51958_T8 (SEQ ID NO:353). Table 491 below describes the starting and ending position of this segment on each transcript.

TABLE 491

Segment location on transcripts

| Transcript name | Segment starting position | Segment ending position |
|---|---|---|
| T51958_T1 (SEQ ID NO: 350) | 3695 | 3730 |
| T51958_T10 (SEQ ID NO: 354) | 3695 | 3730 |
| T51958_T12 (SEQ ID NO: 355) | 4525 | 4560 |
| T51958_T13 (SEQ ID NO: 356) | 2382 | 2417 |
| T51958_T17 (SEQ ID NO: 357) | 2188 | 2223 |
| T51958_T2 (SEQ ID NO: 351) | 2668 | 2703 |
| T51958_T31 (SEQ ID NO: 358) | 3695 | 3730 |
| T51958_T7 (SEQ ID NO: 352) | 2387 | 2422 |
| T51958_T8 (SEQ ID NO: 353) | 3679 | 3714 |

Segment cluster T51958_N46 (SEQ ID NO:399) according to the present invention is supported by 79 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 492 below describes the starting and ending position of this segment on each transcript.

TABLE 492

Segment location on transcripts

| Transcript name | Segment starting position | Segment ending position |
|---|---|---|
| T51958_T1 (SEQ ID NO: 350) | 3731 | 3735 |
| T51958_T10 (SEQ ID NO: 354) | 3731 | 3735 |
| T51958_T12 (SEQ ID NO: 355) | 4561 | 4565 |
| T51958_T13 (SEQ ID NO: 356) | 2418 | 2422 |
| T51958_T17 (SEQ ID NO: 357) | 2224 | 2228 |
| T51958_T2 (SEQ ID NO: 351) | 2704 | 2708 |
| T51958_T31 (SEQ ID NO: 358) | 3731 | 3735 |
| T51958_T7 (SEQ ID NO: 352) | 2423 | 2427 |
| T51958_T8 (SEQ ID NO: 353) | 3715 | 3719 |

Segment cluster T51958_N47 (SEQ ID NO:400) according to the present invention is supported by 77 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 493 below describes the starting and ending position of this segment on each transcript.

TABLE 493

Segment location on transcripts

| Transcript name | Segment starting position | Segment ending position |
|---|---|---|
| T51958_T1 (SEQ ID NO: 350) | 3736 | 3745 |
| T51958_T10 (SEQ ID NO: 354) | 3736 | 3745 |
| T51958_T12 (SEQ ID NO: 355) | 4566 | 4575 |
| T51958_T13 (SEQ ID NO: 356) | 2423 | 2432 |
| T51958_T17 (SEQ ID NO: 357) | 2229 | 2238 |
| T51958_T2 (SEQ ID NO: 351) | 2709 | 2718 |
| T51958_T31 (SEQ ID NO: 358) | 3736 | 3745 |
| T51958_T7 (SEQ ID NO: 352) | 2428 | 2437 |
| T51958_T8 (SEQ ID NO: 353) | 3720 | 3729 |

Segment cluster T51958_N49 (SEQ ID NO:401) according to the present invention is supported by 4 libraries. The number of libraries was determined as previously described. This segment can be found in the following transcript(s): T51958_T10 (SEQ ID NO:354) and T51958_T31 (SEQ ID NO:358). Table 494 below describes the starting and ending position of this segment on each transcript.

TABLE 494

Segment location on transcripts

| Transcript name | Segment starting position | Segment ending position |
|---|---|---|
| T51958_T10 (SEQ ID NO: 354) | 3746 | 3747 |
| T51958_T31 (SEQ ID NO: 358) | 4337 | 4338 |

Segment cluster T51958_N50 (SEQ ID NO:402) according to the present invention is supported by 74 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T31 (SEQ ID NO:358), T51958_T7 (SEQ ID NO:352) and T51958_T8 (SEQ ID NO:353). Table 495 below describes the starting and ending position of this segment on each transcript.

TABLE 495

Segment location on transcripts

| Transcript name | Segment starting position | Segment ending position |
|---|---|---|
| T51958_T1 (SEQ ID NO: 350) | 3746 | 3765 |
| T51958_T10 (SEQ ID NO: 354) | 3748 | 3767 |
| T51958_T12 (SEQ ID NO: 355) | 4576 | 4595 |
| T51958_T13 (SEQ ID NO: 356) | 2433 | 2452 |
| T51958_T17 (SEQ ID NO: 357) | 2239 | 2258 |
| T51958_T2 (SEQ ID NO: 351) | 2719 | 2738 |

TABLE 495-continued

Segment location on transcripts

| Transcript name | Segment starting position | Segment ending position |
|---|---|---|
| T51958_T31 (SEQ ID NO: 358) | 4339 | 4358 |
| T51958_T7 (SEQ ID NO: 352) | 2438 | 2457 |
| T51958_T8 (SEQ ID NO: 353) | 3730 | 3749 |

Segment cluster T51958_N56 (SEQ ID NO:403) according to the present invention is supported by 88 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T7 (SEQ ID NO:352) and T51958_T8 (SEQ ID NO:353). Table 496 below describes the starting and ending position of this segment on each transcript.

TABLE 496

Segment location on transcripts

| Transcript name | Segment starting position | Segment ending position |
|---|---|---|
| T51958_T1 (SEQ ID NO: 350) | 3979 | 4059 |
| T51958_T10 (SEQ ID NO: 354) | 3981 | 4061 |
| T51958_T12 (SEQ ID NO: 355) | 4809 | 4889 |
| T51958_T13 (SEQ ID NO: 356) | 2666 | 2746 |
| T51958_T17 (SEQ ID NO: 357) | 2472 | 2552 |
| T51958_T2 (SEQ ID NO: 351) | 2952 | 3032 |
| T51958_T7 (SEQ ID NO: 352) | 2671 | 2751 |
| T51958_T8 (SEQ ID NO: 353) | 3963 | 4043 |

Segment cluster T51958_N65 (SEQ ID NO:404) according to the present invention is supported by 98 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T7 (SEQ ID NO:352) and T51958_T8 (SEQ ID NO:353). Table 497 below describes the starting and ending position of this segment on each transcript.

TABLE 497

Segment location on transcripts

| Transcript name | Segment starting position | Segment ending position |
|---|---|---|
| T51958_T1 (SEQ ID NO: 350) | 4334 | 4375 |
| T51958_T10 (SEQ ID NO: 354) | 4336 | 4377 |
| T51958_T12 (SEQ ID NO: 355) | 5164 | 5205 |
| T51958_T13 (SEQ ID NO: 356) | 3021 | 3062 |
| T51958_T17 (SEQ ID NO: 357) | 2827 | 2868 |
| T51958_T2 (SEQ ID NO: 351) | 3307 | 3348 |
| T51958_T7 (SEQ ID NO: 352) | 3026 | 3067 |
| T51958_T8 (SEQ ID NO: 353) | 4318 | 4359 |

Segment cluster T51958_N66 (SEQ ID NO:405) according to the present invention is supported by 90 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T7 (SEQ ID NO:352) and T51958_T8 (SEQ ID NO:353). Table 498 below describes the starting and ending position of this segment on each transcript.

TABLE 498

Segment location on transcripts

| Transcript name | Segment starting position | Segment ending position |
|---|---|---|
| T51958_T1 (SEQ ID NO: 350) | 4376 | 4390 |
| T51958_T10 (SEQ ID NO: 354) | 4378 | 4392 |
| T51958_T12 (SEQ ID NO: 355) | 5206 | 5220 |
| T51958_T13 (SEQ ID NO: 356) | 3063 | 3077 |
| T51958_T17 (SEQ ID NO: 357) | 2869 | 2883 |
| T51958_T2 (SEQ ID NO: 351) | 3349 | 3363 |
| T51958_T7 (SEQ ID NO: 352) | 3068 | 3082 |
| T51958_T8 (SEQ ID NO: 353) | 4360 | 4374 |

Segment cluster T51958_N69 (SEQ ID NO:406) according to the present invention is supported by 123 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T7 (SEQ ID NO:352) and T51958_T8 (SEQ ID NO:353). Table 499 below describes the starting and ending position of this segment on each transcript.

TABLE 499

Segment location on transcripts

| Transcript name | Segment starting position | Segment ending position |
|---|---|---|
| T51958_T1 (SEQ ID NO: 350) | 5091 | 5101 |
| T51958_T10 (SEQ ID NO: 354) | 5093 | 5103 |
| T51958_T12 (SEQ ID NO: 355) | 5921 | 5931 |
| T51958_T13 (SEQ ID NO: 356) | 3778 | 3788 |
| T51958_T17 (SEQ ID NO: 357) | 3584 | 3594 |
| T51958_T2 (SEQ ID NO: 351) | 4064 | 4074 |
| T51958_T7 (SEQ ID NO: 352) | 3783 | 3793 |
| T51958_T8 (SEQ ID NO: 353) | 5075 | 5085 |

Segment cluster T51958_N70 (SEQ ID NO:407) according to the present invention is supported by 126 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T7 (SEQ ID NO:352) and T51958_T8 (SEQ ID NO:353). Table 500 below describes the starting and ending position of this segment on each transcript.

TABLE 500

Segment location on transcripts

| Transcript name | Segment starting position | Segment ending position |
|---|---|---|
| T51958_T1 (SEQ ID NO: 350) | 5102 | 5120 |
| T51958_T10 (SEQ ID NO: 354) | 5104 | 5122 |

TABLE 500-continued

Segment location on transcripts

| Transcript name | Segment starting position | Segment ending position |
|---|---|---|
| T51958_T12 (SEQ ID NO: 355) | 5932 | 5950 |
| T51958_T13 (SEQ ID NO: 356) | 3789 | 3807 |
| T51958_T17 (SEQ ID NO: 357) | 3595 | 3613 |
| T51958_T2 (SEQ ID NO: 351) | 4075 | 4093 |
| T51958_T7 (SEQ ID NO: 352) | 3794 | 3812 |
| T51958_T8 (SEQ ID NO: 353) | 5086 | 5104 |

Segment cluster T51958_N71 (SEQ ID NO:408) according to the present invention is supported by 127 libraries. The number of libraries was determined as previously described. This segment can be found in the following transcript(s): T51958_T1 (SEQ ID NO:350), T51958_T10 (SEQ ID NO:354), T51958_T12 (SEQ ID NO:355), T51958_T13 (SEQ ID NO:356), T51958_T17 (SEQ ID NO:357), T51958_T2 (SEQ ID NO:351), T51958_T7 (SEQ ID NO:352) and T51958_T8 (SEQ ID NO:353). Table 501 below describes the starting and ending position of this segment on each transcript.

TABLE 501

Segment location on transcripts

| Transcript name | Segment starting position | Segment ending position |
|---|---|---|
| T51958_T1 (SEQ ID NO: 350) | 5121 | 5136 |
| T51958_T10 (SEQ ID NO: 354) | 5123 | 5138 |
| T51958_T12 (SEQ ID NO: 355) | 5951 | 5966 |
| T51958_T13 (SEQ ID NO: 356) | 3808 | 3823 |
| T51958_T17 (SEQ ID NO: 357) | 3614 | 3629 |
| T51958_T2 (SEQ ID NO: 351) | 4094 | 4109 |
| T51958_T7 (SEQ ID NO: 352) | 3813 | 3828 |
| T51958_T8 (SEQ ID NO: 353) | 5105 | 5120 |

The alignment of T51958 variant proteins to the previously known proteins is shown in the attached CD-Rom Expression of T51958 transcripts which are detectable by amplicon as depicted in sequence name T51958 junc21-33 (SEQ ID NO:508) in normal and cancerous colon tissues:

Expression of transcripts detectable by or according to junc21-33, T51958 junc21-33 (SEQ ID NO:508) amplicon(s) and primers T51958 junc21-33F (SEQ ID NO:506) and T51958 junc21-33R (SEQ ID NO:507) was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), G6PD (GenBank Accession No. NM_000402 (SEQ ID NO:442); G6PD amplicon (SEQ ID NO:445)), RPS27A (GenBank Accession No. NM_002954 (SEQ ID NO:446); RPS27A amplicon (SEQ ID NO:446)) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 41, 52, 62-67, 69-71, Table 2_3, above "Tissue samples in colon cancer testing panel"), to obtain a value of fold up-regulation for each sample relative to median of the normal PM samples.

Figure 44:
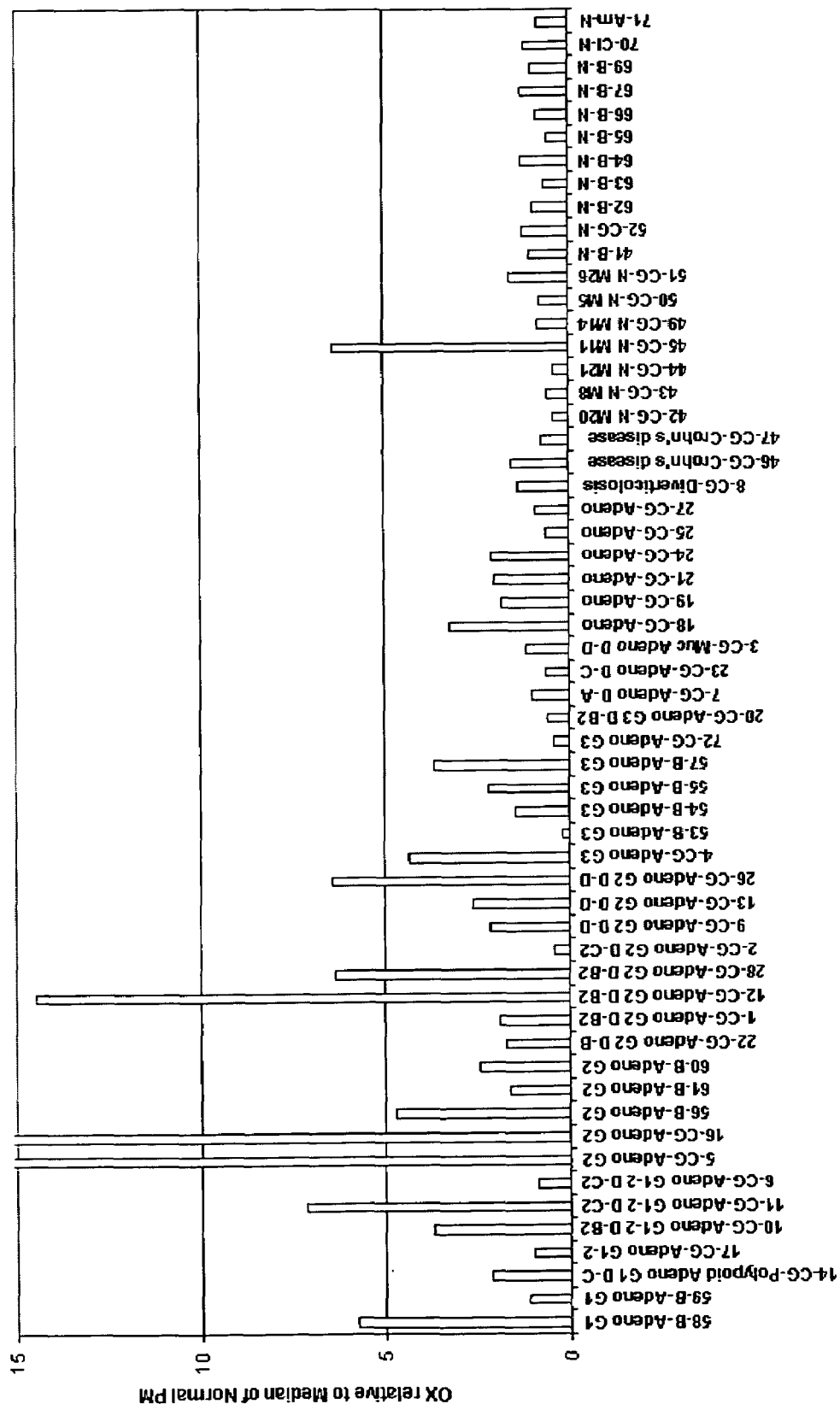
FIG. 44 is a histogram showing over expression of the T51958 transcripts which are detectable by amplicon as depicted in sequence name T51958 junc21-33 (SEQ ID NO:508) in cancerous colon samples relative to the normal samples.

FIG. 44 is a histogram showing over expression of the above-transcripts in cancerous colon samples relative to the normal samples.

As is evident from FIG. 44, the expression of transcripts detectable by the above amplicon(s) was higher in a few cancer samples than in the non-cancerous samples (Sample Nos. 41, 52, 62-67, 69-71, Table 2_3 above "Tissue samples in colon cancer testing panel"). Notably an over-expression of at least 3 fold was found in 12 out of 36 adenocarcinoma samples.

Statistical analysis was applied to verify the significance of these results, as described below.

The P value for the difference in the expression levels of WT or previously known transcripts detectable by the above amplicon(s) in colon cancer samples versus the normal tissue samples was determined by T test as 2E-03. The above value demonstrates statistical significance of the results. Primer pairs are also optionally and preferably encompassed within the present invention; for example, for the above experiment, the following primer pair was used as a non-limiting illustrative example only of a suitable primer pair: T51958 junc21-33F (SEQ ID NO:506) forward primer; and T51958 junc21-33R (SEQ ID NO:507) reverse primer.

The present invention also preferably encompasses any amplicon obtained through the use of any suitable primer pair; for example, for the above experiment, the following amplicon was obtained as a non-limiting illustrative example only of a suitable amplicon: T51958 junc21-33 (SEQ ID NO:508).

```
Primers:

Forward primer T51958 junc21-33F (SEQ ID NO: 506):
ATCACTGTGGCCAATGGGA

Reverse primer T51958 junc21-33R (SEQ ID NO: 507):
CCCGTTGGAGGCAATGC

Amplicon T51958 junc21-33 (SEQ ID NO: 508):
ATCACTGTGGCCAATGGGAGCAGCCTCCCAGAGTGGGTGACAGACAACGCTGGGACC

CTGCATTTTGCCCGGGTGACTCGAGATGACGCTGGCAACTACACTTGCATTGCCTCCA

ACGGG
```

The conversion of the T51958 junc21-33 (SEQ ID NO:508) name to the currently available sequence version, as listed in Table 420, is as follows: T51958 junc17-30.

Expression of Homo sapiens PTK7 protein tyrosine kinase 7 (PTK7) T51958 transcripts which are detectable by amplicon as depicted in sequence name T51958seg38 (SEQ ID NO:511) in normal and cancerous colon tissues:

Expression of Homo sapiens PTK7 protein tyrosine kinase 7 (PTK7) transcripts detectable by or according to seg38, T51958seg38 (SEQ ID NO:511) amplicon and T51958seg38F (SEQ ID NO:509) and T51958seg38R (SEQ ID NO:510) primers was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434) ; amplicon—HPRT1-amplicon (SEQ ID NO:437)), G6PD (GenBank Accession No. NM_000402 (SEQ ID NO:442); G6PD amplicon (SEQ ID NO:445)), RPS27A (GenBank Accession No. NM_002954 (SEQ ID NO:446); RPS27A amplicon (SEQ ID NO:446)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 41, 52, 62-67, 69-71, Table 2_3, above, "Tissue samples in colon cancer testing panel"), to obtain a value of fold up-regulation for, each sample relative to median of the normal PM samples.

Figure 45:
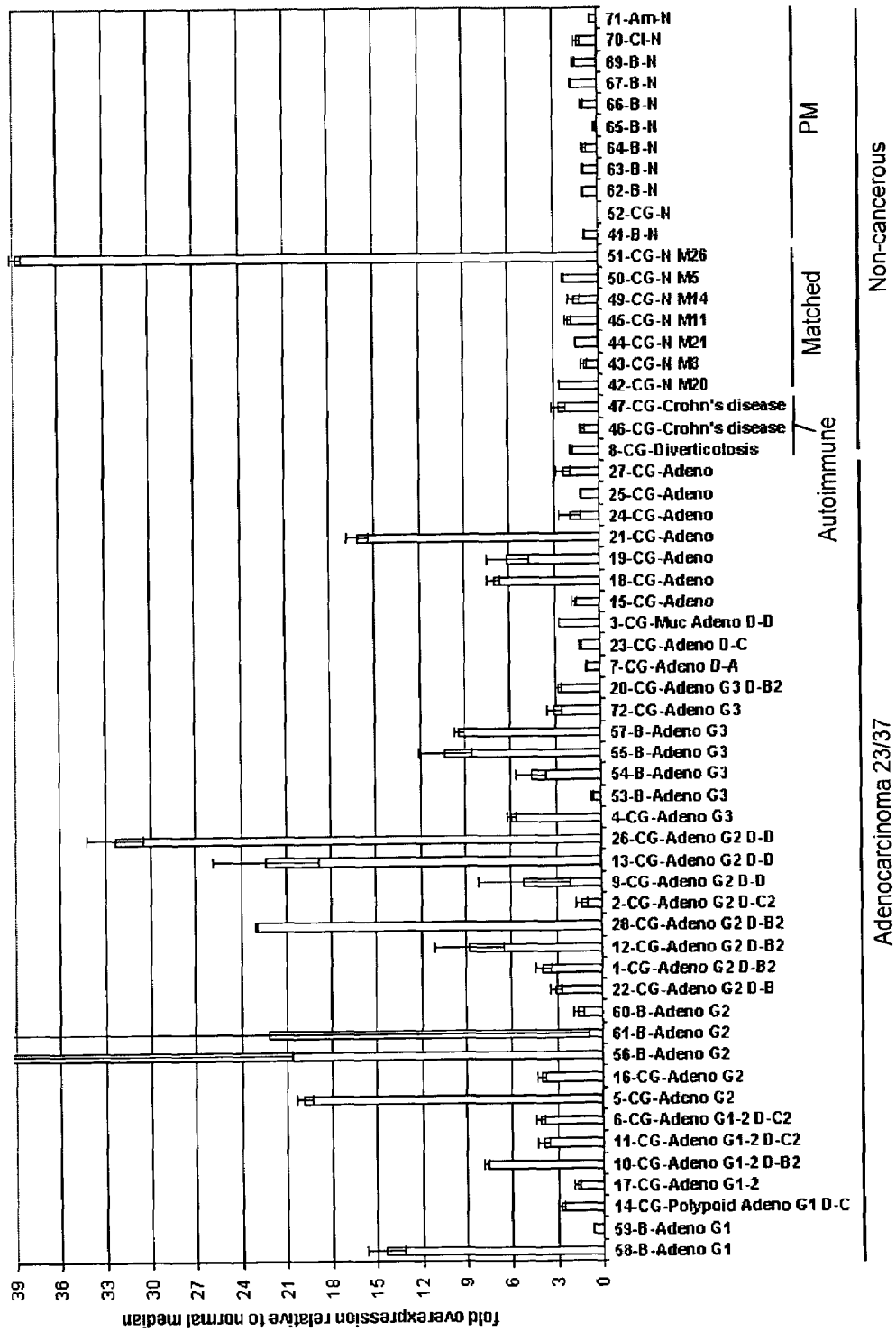
FIG. 45 is a histogram showing over expression of the Expression of *Homo sapiens* PTK7 protein tyrosine kinase 7 (PTK7) T51958 transcripts which are detectable by amplicon as depicted in sequence name T51958seg38 (SEQ ID NO:511) in normal and cancerous colon tissues.

FIG. 45 is a histogram showing over expression of the above-indicated Homo sapiens PTK7 protein tyrosine kinase 7 (PTK7) transcripts in cancerous colon samples relative to the normal samples. (Values represent the average of duplicate experiments. Error bars indicate the minimal and maximal values obtained.) The number of samples that exhibit at least 3 fold over-expression, out of the total number of samples tested is indicated in the bottom.

As is evident from FIG. 45, the expression of Homo sapiens PTK7 protein tyrosine kinase 7 (PTK7) transcripts detectable by the above amplicon in cancer samples was significantly higher than in the non-cancerous samples (Sample Nos 41, 52, 62-67, 69-71, Table 2_3, "Tissue samples in colon cancer testing panel"). Notably an over-expression of at least 3 fold was found in 23 out of 37 adenocarcinoma samples, Statistical analysis was applied to verify the significance of these results, as described below.

The P value for the difference in the expression levels of Homo sapiens PTK7 protein tyrosine kinase 7 (PTK7) transcripts detectable by the above amplicon in colon cancer samples versus the normal tissue samples was determined by T test as 4.58E-04.

Threshold of 3 fold overexpression was found to differentiate between cancer and normal samples with P value of 1.97E-04 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: T51958seg38F (SEQ ID NO:509) forward primer; and T51958seg38R (SEQ ID NO:510) reverse primer.

The present invention also preferably encompasses any amplicon obtained through the use of any suitable primer pair; for example, for the above experiment, the following amplicon was obtained as a non-limiting illustrative example only of a suitable amplicon: T51958seg38 (SEQ ID NO:511).

T51958seg38F (SEQ ID NO:509): GCTTGCCCTTTCAT-GTGGA

T51958seg38R (SEQ ID NO:510): TCACGATGAGACCT-GACACTCTG

T51958seg38 (SEQ ID NO:511): GCTTGCCCTTTCAT-GTGGAGCACTGTGATTGGACCCAAGTTG-GCAAGAGTGGAAGACC AGGGGACAGAACA-GAAATCCCCATGGTGGCCAGAGTGTCAGGTCTC-ATCGTGA The conversion of the T51958seg38 (SEQ ID NO:511) name to the currently available sequence version, as listed in Table 420, is as follows: T51958seg42.

Expression of Homo sapiens PTK7 protein tyrosine kinase 7 (PTK7) T51958 transcripts which are detectable by amplicon as depicted in sequence name T51958seg7 (SEQ ID NO:514) in normal and cancerous colon tissues:

Expression of Homo sapiens PTK7 protein tyrosine kinase 7 (PTK7) transcripts detectable by or according to seg7, T51958seg7 (SEQ ID NO:514) amplicon and T51958seg7F (SEQ ID NO:512) and T51958seg7R (SEQ ID NO:513) primers was measured by real time PCR. In parallel the expression of four housekeeping genes—PBGD (GenBank Accession No. BC019323 (SEQ ID NO:430); amplicon—PBGD-amplicon (SEQ ID NO:433)), HPRT1 (GenBank Accession No. NM_000194 (SEQ ID NO:434); amplicon—HPRT1-amplicon (SEQ ID NO:437)), G6PD (GenBank Accession No. NM_000402 (SEQ ID NO:442); G6PD amplicon (SEQ ID NO:445)), RPS27A (GenBank Accession No. NM_002954 (SEQ ID NO:446); RPS27A amplicon (SEQ ID NO:446)), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 41, 52, 62-67, 69-71, Table 2_3, above, "Tissue samples in colon cancer testing panel"), to obtain a value of fold up-regulation for each sample relative to median of the normal PM samples.

Figure 46:
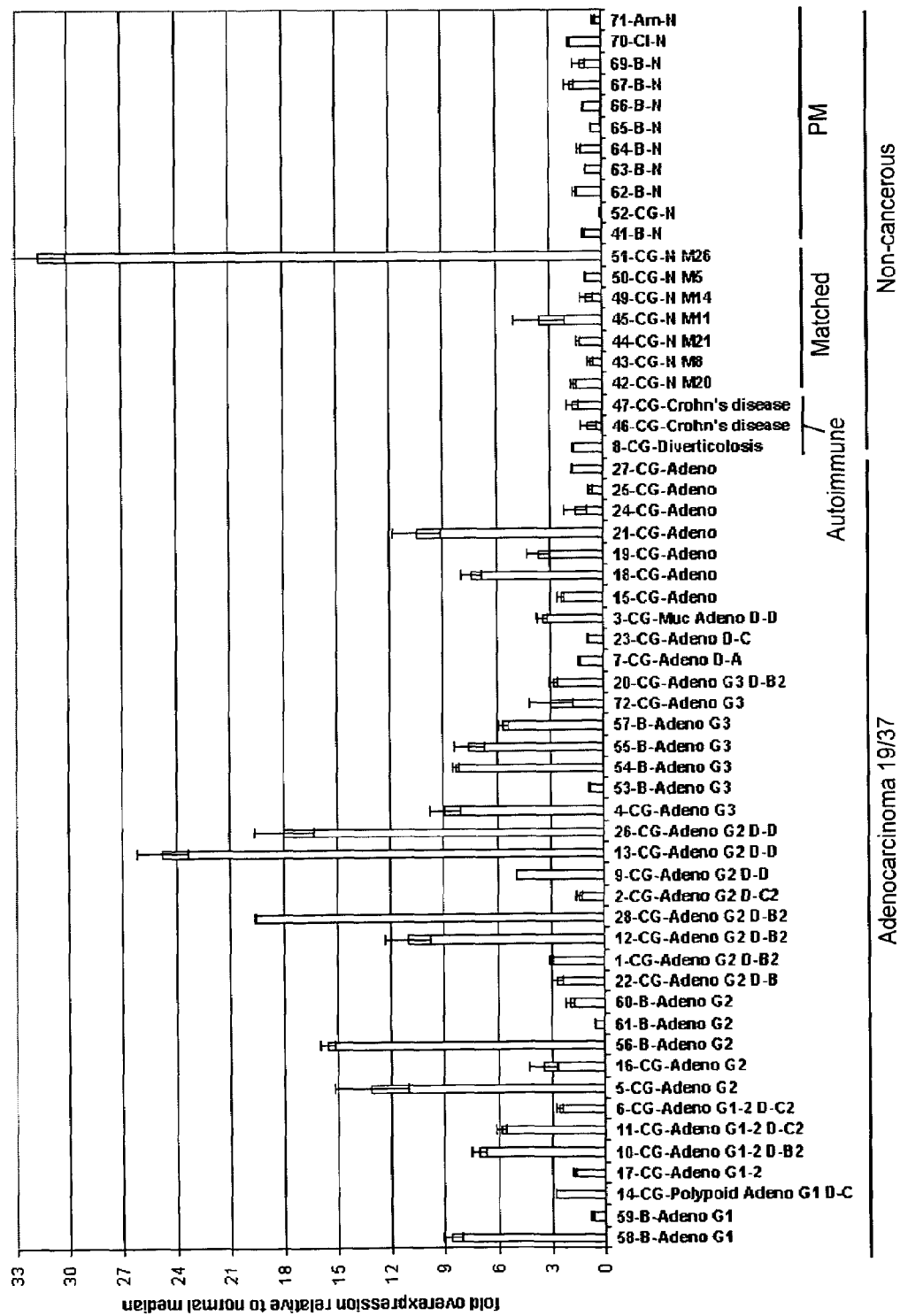
FIG. 46 is a histogram showing over expression of the Expression of *Homo sapiens* PTK7 protein tyrosine kinase 7 (PTK7) T51958 transcripts which are detectable by amplicon as depicted in sequence name T51958seg7 (SEQ ID NO:514) in normal and cancerous colon tissues.

FIG. 46 is a histogram showing over expression of the above-indicated Homo sapiens PTK7 protein tyrosine kinase 7 (PTK7) transcripts in cancerous colon samples relative to the normal samples. (Values represent the average of duplicate experiments. Error bars indicate the minimal and maximal values obtained.) The number of samples that exhibit at least 3 fold over-expression, out of the total number of samples tested is indicated in the bottom.

As is evident from FIG. 46 the expression of Homo sapiens PTK7 protein tyrosine kinase 7 (PTK7) transcripts detectable by the above amplicon in cancer samples was significantly higher than in the non-cancerous samples (Sample Nos. 41, 52, 62-67, 69-71, Table 2_3, "Tissue samples in colon cancer testing panel"). Notably an over-expression of at least 3 fold was found in 19 out of 37 adenocarcinoma samples, Statistical analysis was applied to verify the significance of these results, as described below.

The P value for the difference in the expression levels of Homo sapiens PTK7 protein tyrosine kinase 7 (PTK7) transcripts detectable by the above amplicon in colon cancer samples versus the normal tissue samples was determined by T test as 1.74E-05.

Threshold of 3 fold overexpression was found to differentiate between cancer and normal samples with P value of 1.53E-03 as checked by exact fisher test. The above values demonstrate statistical significance of the results.

RPL19 amplicon (SEQ ID NO:453)) and TATA box (GenBank Accession No. NM_003194 (SEQ ID NO:454); TATA amplicon (SEQ ID NO:457)) was measured similarly. For each RT sample, the expression of the above amplicon was normalized to the geometric mean of the quantities of the housekeeping genes. The normalized quantity of each RT sample was then divided by the median of the quantities of the colon samples (sample numbers 1, 2 and 3, Table 2_6 above: "Tissue samples in normal panel"), to obtain a value of relative expression of each sample relative to median of the colon samples.

```
Primers:
Forward Primer (T51958_seg38F (SEQ ID NO: 509)):
GCTTGCCCTTTCATGTGGA Reverse Primer (T51958_seg38R (SEQ ID NO: 510)):
TCACGATGAGACCTGACACTCTG Amplicon (T51958_seg38 (SEQ ID NO: 511)):
GCTTGCCCTTTCATGTGGAGCACTGTGATTGGACCCAAGTTGGCAAGAGTGGAAGACC

AGGGGACAGAACAGAAATCCCCATGGTGGCCAGAGTGTCAGGTCTCATCGTGA
```

Primer pairs are also optionally and preferably encompassed within the present invention; for example, for the above experiment, the following primer pair was used as a non-limiting illustrative example only of a suitable primer pair: T51958seg7F (SEQ ID NO:512) forward primer; and T51958seg7R (SEQ ID NO:513) reverse primer.

The present invention also preferably encompasses any amplicon obtained through the use of any suitable primer pair; for example, for the above experiment, the following amplicon was obtained as a non-limiting illustrative example only of a suitable amplicon: T51958seg7 (SEQ ID NO:5 14).
T51958seg7F (SEQ ID NO:512): GTGCCCAGTCCCCCT-GTC
T51958seg7R (SEQ ID NO:513): CCTGGCCCGTT-TAACTGGA
T51958seg7 (SEQ ID NO:514): GTGCCCAGTCCCCCT-GTCAGACCCTCAATGACTGAGGC-CTGGGGGATCCCTCCCTTAC CTCAGCTTCTC-CCATTTCCAGTTAAACGGGCCAGG The conversion of the T51958seg7 (SEQ ID NO:514) name to the currently available sequence version, as listed in Table 420, is as follows: T51958seg5.

Expression of Homo sapiens protein tyrosine kinase 7 (PTK7) T51958 transcripts which are detectable by amplicon as depicted in sequence name T51958_seg38 (SEQ ID NO:511) in different normal tissues:

Expression of Homo sapiens protein tyrosine kinase 7 (PTK7) transcripts detectable by or according to seg38-T51958_seg38 (SEQ ID NO:511) amplicon and primers T51958_seg38F (SEQ ID NO:509) and T51958_seg38R (SEQ ID NO:510) was measured by real time PCR. In parallel the expression of four housekeeping genes—SDHA (GenBank Accession No. NM_004168 (SEQ ID NO:462); amplicon—SDHA-amplicon (SEQ ID NO:465)), Ubiquitin (GenBank Accession No. BC000449 (SEQ ID NO:458)); amplicon—Ubiquitin-amplicon (SEQ ID NO:461)), RPL19 (GenBank Accession No. NM_000981 (SEQ ID NO:450));

The conversion of the T51958seg38 (SEQ ID NO:511) name to the currently available sequence version, as listed in Table 420, is as follows: T51958seg42.

Figure 47:
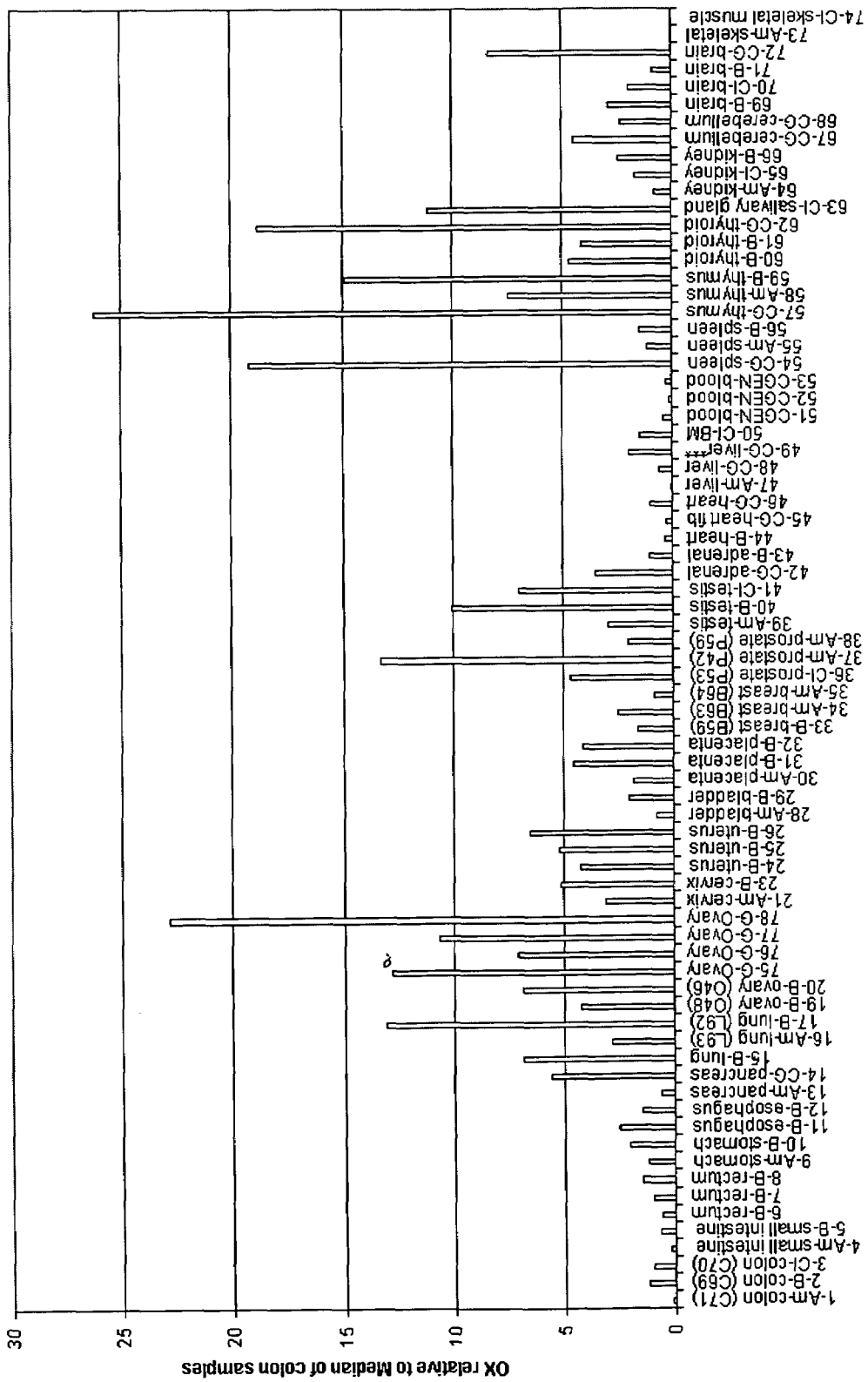
FIG. 47 is a histogram showing the expression of *Homo sapiens* protein tyrosine kinase 7 (PTK7) T51958 transcripts which are detectable by amplicon as depicted in sequence name T51958_seg38 (SEQ ID NO:511) in different normal tissues.

FIG. 47 is a histogram showing the expression of Homo sapiens protein tyrosine kinase 7 (PTK7) T51958 transcripts which are detectable by amplicon as depicted in sequence name T51958_seg38 (SEQ ID NO:511) in different normal tissues.

Expression of Homo sapiens protein tyrosine kinase 7 (PTK7) T51958 transcripts which are detectable by amplicon as depicted in sequence name T51958_seg7 (SEQ ID NO:514) in different normal tissues:

Expression of Homo sapiens protein tyrosine kinase 7 (PTK7) transcripts detectable by or according to seg7-T51958_seg7 (SEQ ID NO:514) amplicon and primers T51958_seg7F (SEQ ID NO:512)) and T51958_seg7R (SEQ ID NO:513) was measured by real time PCR. In parallel the expression of four housekeeping genes—SDHA (GenBank Accession No. NM_004168 (SEQ ID NO:462); amplicon—SDHA-amplicon (SEQ ID NO:465)), Ubiquitin (GenBank Accession No. BC000449 (SEQ ID NO:458); amplicon—Ubiquitin-amplicon (SEQ ID NO:461)), RPL19 (GenBank Accession No. NM_000981 (SEQ ID NO:450); RPL19 amplicon (SEQ ID NO:453)) and TATA box (GenBank Accession No. NM_003194 (SEQ ID NO:454); TATA amplicon (SEQ ID NO:457)) was measured similarly. For each RT sample, the expression of the above amplicon was normalized to the geometric mean of the quantities of the housekeeping genes. The normalized quantity of each RT sample was then divided by the median of the quantities of the colon samples (sample numbers 1, 2 and 3, Table 2_6 above: "Tissue samples in normal panel"), to obtain a value of relative expression of each sample relative to median of the colon samples.

```
Primers:
Forward Primer (T51958_seg7F (SEQ ID NO: 512)):
GTGCCCAGTCCCCCTGTC

Reverse Primer (T51958_seg7R (SEQ ID NO: 513)):
CCTGGCCCGTTTAACTGGA

Amplicon (T51958_seg7 (SEQ ID NO: 514)):
GTGCCCAGTCCCCCTGTCAGACCCTCAATGACTGAGGCCTGGGGGATCCCTCCCTTAC

CTCAGCTTCTCCCATTTCCAGTTAAACGGGCCAGG
```

The conversion of the T51958seg7 (SEQ ID NO:514) name to the currently available sequence version, as listed in Table 420, is as follows: T51958seg5.

Figure 48:
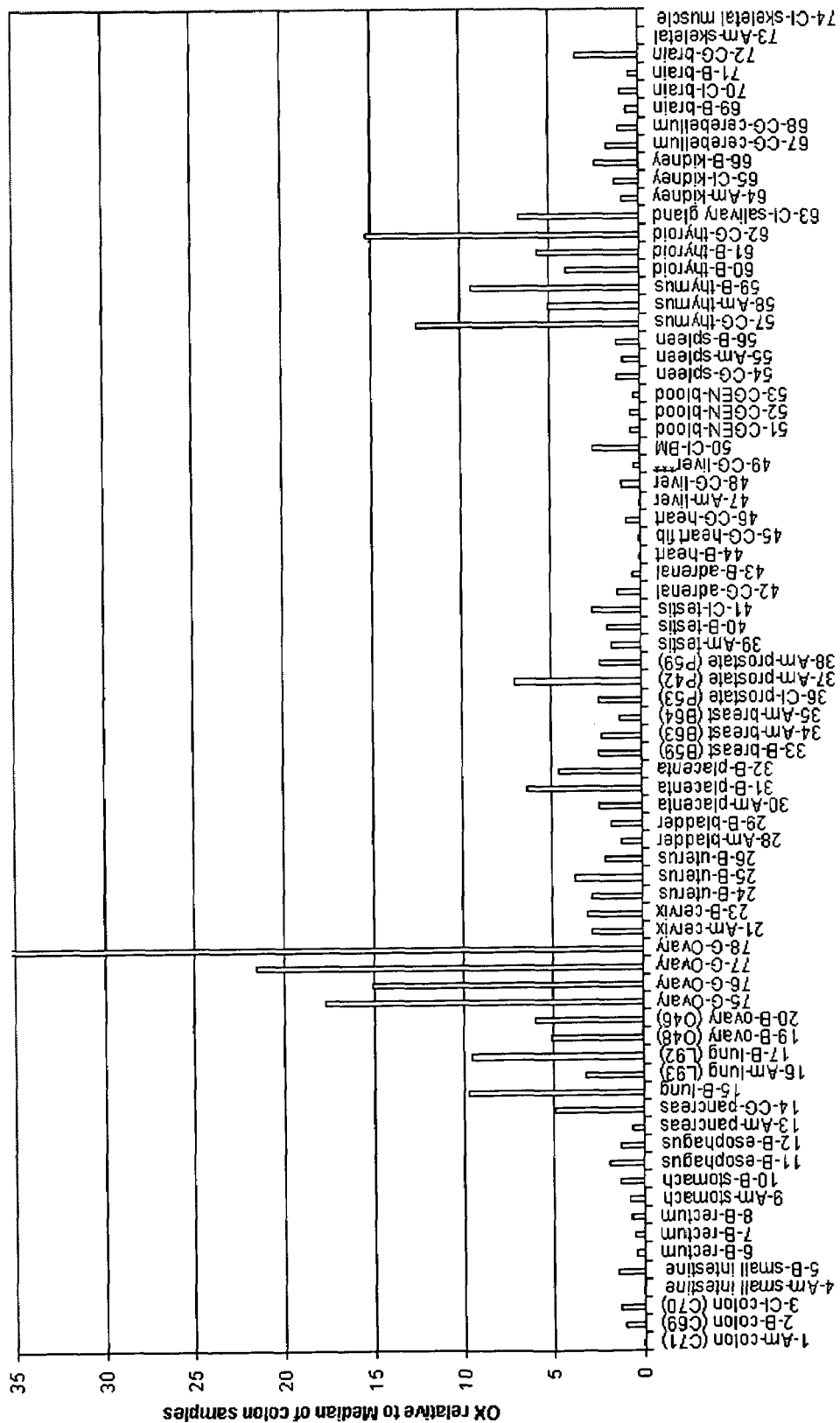
FIG. 48 is a histogram showing the expression of *Homo sapiens* protein tyrosine kinase 7 (PTK7) T51958 transcripts which are detectable by amplicon as depicted in sequence name T51958_seg7 (SEQ ID NO:514) in different normal tissues.

FIG. 48 is a histogram showing the expression of Homo sapiens protein tyrosine kinase 7 (PTK7) T51958 transcripts which are detectable by amplicon as depicted in sequence name T51958_seg7 (SEQ ID NO:514) in different normal tissues.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims. All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention.

SEQUENCE LISTING (644 sequences)

SEQ ID NO: 1 - DNA, 6008 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagagatgaggtctcactatgttacccaggctggtttcaaactcctggcctcatgggattctccagcctcagtctcccaaagtgctgggattacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgacaaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggttagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgcgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaaaatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactcttaaaaaatac

SEQ ID NO: 2 - DNA, 5963 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacaggcttctctccacagaccatcccgggtggcatttgggacccagctggagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgacaaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggttagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgcgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaaaatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactcttaaaaaatac

SEQ ID NO: 3 - DNA, 5773 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatgaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgacaaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggttagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgcgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaaaatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactcttaaaaaatac

SEQ ID NO: 4 - DNA, 5751 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgacaaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggttagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgcgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaaaatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactcttaaaaaatac

SEQ ID NO: 5 - DNA, 2036 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagacaggctttctcctcgttgcccaggatggagtacagcagtgcaatcacagctcacggcaacttctgcctcctgggttcaagcaatcctcccgcctcagcctcctaagtagctgggaccacaggcgtgtgccacaatgctaattttttaaaaatgttttgtagagacagggtttcaccatgctgcccaggctggtctcgaactcctggcctcaagtgatccaccagcctcagactcccaaagtgctgggattactggtgtgagccactgcacctgactaaactttaaatttttttttttagacggaatctcgctctgttgcccaggctggagtgcagtggcatgatattggctcactgcaagctctgcctcttgggttcacgctattctcctgcctcagcctcctgagtagctgggactacaggtgcacaccaccacgcccggctaatttttttttttttttagtagagacggggtttcactgtgttggccaggctggtcttgaactcctgacctcgtgatccacccgcctcgccctcccaaaatgctgggattacaggtgtgagccaccgcgcctggcctaaacttttaaaattttaatcaaattaatacatgcacatggcaaagaagtaataaacagcttataacactg

SEQ ID NO: 6 - DNA, 2471 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagacaggctttctcctcgttgcccaggatggagtacagcagtgcaatcacagctcacggcaacttctgcctcctgggttcaagcaatcctcccgcctcagcctcctaagtagctgggaccacaggcgtgtgccacaatgctaattttttaaaaatgttttgtagagacagggtttcaccatgctgcccaggctggtctcgaactcctggcctcaagtgatccaccagcctcagactcccaaagtgctgggattactggtgtgagccactgcacctgactaaactttaaatttttttttttagacggaatctcgctctgttgcccaggctggagtgcagtggcatgatattggctcactgcaagctctgcctcttgggttcacgctattctcctgcctcagcctcctgagtagctgggactacaggtgcacaccaccacgcccggctaatttttttttttttttagtagagacggggtttcactgtgttggccaggctggtcttgaactcctgacctcgtgatccacccgcctcgccctcccaaaatgctgggattacaggtgtgagccaccgcgcctggcctaaacttttaaaattttaatcaaattaatacatgcacatggcaaagaagtaataaacagcttataacactgagcagtggtcccttgtcccatgccttccatttctagtcctgctttctaaggaagctgcttgactctttctgtttctagttcctctgttggtgccctccttaactctaaacaacaagcttatatcgcttttttttttccctgataaaaccacttgagacattatctatcaacaccctgctatgaaaggttaggatttagcagatctagaatgcaagaatctccctgaccacaacccagagagtggtcagccagcctctgcttaaatgcttccagagacagagagcttactaccccttgcagcaatctgttttattgttcccagtgtttttgttgtagaatggcttcatggctcactttggggtcaaatgtttctagccctgtggcgtagttgaaccaaattaatcattcttaaatacttggcagttaggaaaaaaa

SEQ ID NO: 7 - DNA, 522 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcagg

SEQ ID NO: 8 - DNA, 249 bp, Homo sapiens
aggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatg

SEQ ID NO: 9 - DNA, 124 bp, Homo sapiens
ttccccccgaggagccccagctctcctgcttccggaagagccccctcagcaatgttgtttgtgagtggggtcctcggagcaccccatccctgacgacaaaggctgtgctcttggtgaggaagtt

SEQ ID NO: 10 - DNA, 182 bp, Homo sapiens
tcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatct

SEQ ID NO: 11 - DNA, 167 bp, Homo sapiens
tgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatg

SEQ ID NO: 12 - DNA, 142 bp, Homo sapiens
gtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacag

SEQ ID NO: 13 - DNA, 1085 bp, Homo sapiens
acaggctttctcctcgttgcccaggatggagtacagcagtgcaatcacagctcacggcaacttctgcctcctgggttcaagcaatcctcccgcctcagcctcctaagtagctgggaccacaggcgtgtgccacaatgctaattttttaaaaatgttttgtagagacagggtttcaccatgctgcccaggctggtctcgaactcctggcctcaagtgatccaccagcctcagactcccaaagtgctgggattactggtgtgagccactgcacctgactaaactttaaatttttttttttagacggaatctcgctctgttgcccaggctggagtgcagtggcatgatattggctcactgcaagctctgcctcttgggttcacgctattctcctgcctcagcctcctgagtagctgggactacaggtgcacaccaccacgcccggctaatttttttttttttttagtagagacggggtttcactgtgttggccaggctggtcttgaactcctgacctcgtgatccacccgcctcgccctcccaaaatgctgggattacaggtgtgagccaccgcgcctggcctaaacttttaaaattttaatcaaattaatacatgcacatggcaaagaagtaataaacagcttataacactgagcagtggtcccttgtcccatgccttccatttctagtcctgctttctaaggaagctgcttgactctttctgtttctagttcctctgttggtgccctccttaactctaaacaacaagcttatatcgcttttttttttccctgataaaaccacttgagacattatctatcaacaccctgctatgaaaggttaggatttagcagatctagaatgcaagaatctccctgaccacaacccagagagtggtcagccagcctctgcttaaatgcttccagagacagagagcttactaccccttgcagcaatctgttttattgttcccagtgtttttgttgtagaatggcttcatggctcactttggggtcaaatgtttctagccctgtggcgtagttgaaccaaattaatcattcttaaatacttggcagttaggaaaaaaa

SEQ ID NO: 14 - DNA, 4318 bp, Homo sapiens
gttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgacaaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggttagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgcgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaaaatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactcttaaaaaatac

SEQ ID NO: 15 - DNA, 48 bp, Homo sapiens
gcttctctccacagaccatcccgggtggcatttgggacccagctggag

SEQ ID NO: 16 - DNA, 93 bp, Homo sapiens
agatgaggtctcactatgttacccaggctggtttcaaactcctggcctcatgggattctccagcctcagtctcccaaagtgctgggattacag

SEQ ID NO: 17 - DNA, 47 bp, Homo sapiens
aatccaggagtcctccagctgagaacgaggtgtccacccccatgcag

SEQ ID NO: 18 - DNA, 70 bp, Homo sapiens
gcacttactactaataaagacgatgataatattctcttcagagattctgcaaatgcgacaagcctcccag

SEQ ID NO: 19 - DNA, 94 bp, Homo sapiens
tgcaagattcttcttcagtaccactgcccacattcctggttgctggagggagcctggccttcggaacgctcctctgcattgccattgttctgag

SEQ ID NO: 20 - protein, 468 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 21 - protein, 468 aa, Homo sapiens; identical to SEQ ID NO: 20

SEQ ID NO: 22 - protein, 365 aa, Homo sapiens [sequence omitted]

SEQ ID NO: 23 - protein, 365 aa, Homo sapiens [sequence omitted]

SEQ ID NO: 24 - protein, 499 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTEMRSHYVTQAGFKLLASWDSPASVSQSAGITESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 25 - protein, 484 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTGFSPQTIPGGIWDPAGESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 26 - protein, 338 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMNPGVLQLRTRCPPPCRHLLLIKTMIIFSSEILQMRQASQCKILLQYHCPHSWLLEGAWPSERSSALPLF

SEQ ID NO: 27 - protein, 384 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQVQEDVEAAGSEGRQDKHASAVLFGAAGPGEASTHPSACSSHLPTGVPQQPGV

SEQ ID NO: 28 - protein, 352 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTDRLSPRCPGWSTAVQSQLTATSASWVQAILPPQPPK

SEQ ID NO: 29 - DNA, 2493 bp, Homo sapiens
gccaggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctggtgagtccccagaactctgcccggcaaggtgggtccgtgtgctggcgctcactgtccacccaccgtgtccccagggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 30 - DNA, 2248 bp, Homo sapiens
gccaggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctgggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 31 - DNA, 2134 bp, Homo sapiens
gccaggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 32 - DNA, 2194 bp, Homo sapiens
gccaggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 33 - DNA, 1924 bp, Homo sapiens
gccaggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 34 - DNA, 251 bp, Homo sapiens
gtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccag

SEQ ID NO: 35 - DNA, 121 bp, Homo sapiens
cctctcccctcgccaactccttggcttcccgtgtgcggaggtgtccggcctgagcacggagcgtgtccgggagctggctgtggccttggcacagaagaatgtcaagctctcaacagagcag

SEQ ID NO: 36 - DNA, 179 bp, Homo sapiens
agacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgag

SEQ ID NO: 37 - DNA, 156 bp, Homo sapiens
ctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcag

SEQ ID NO: 38 - DNA, 188 bp, Homo sapiens
gacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 39 - DNA, 56 bp, Homo sapiens
gccaggctctccacccccacttcccaattgaggaaaccgaggcagaggaggctcag

SEQ ID NO: 40 - DNA, 60 bp, Homo sapiens
cgccacgcactcctctttctgcctggccggccactcccgtctgctgtgacgcgcggacag

SEQ ID NO: 41 - DNA, 42 bp, Homo sapiens
agagctaccggtggacccacggtgcctccctccctgggatct

SEQ ID NO: 42 - DNA, 54 bp, Homo sapiens
acacagaccatggccttgccaacggctcgacccctgttggggtcctgtgggacc

SEQ ID NO: 43 - DNA, 40 bp, Homo sapiens
cccgccctcggcagcctcctgttcctgctcttcagcctcg

SEQ ID NO: 44 - DNA, 44 bp, Homo sapiens
gatgggtgcagccctcgaggaccctggctggagagacagggcag

SEQ ID NO: 45 - DNA, 3 bp, Homo sapiens
gag

SEQ ID NO: 46 - DNA, 47 bp, Homo sapiens
gctgcgcccctggacggagtcctggccaacccacctaacatttccag

SEQ ID NO: 47 - DNA, 80 bp, Homo sapiens
ctgcgctgtctggctcaccggctctctgagccccccgaggacctggacgccctcccattggacctgctgctattcctcaa

SEQ ID NO: 48 - DNA, 106 bp, Homo sapiens
cccagatgcgttctcggggccccaggcctgcacccgtttcttctcccgcatcacgaaggccaatgtggacctgctcccgaggggggctcccgagcgacagcggctg

SEQ ID NO: 49 - DNA, 24 bp, Homo sapiens
ctgcctgcggctctggcctgctgg

SEQ ID NO: 50 - DNA, 114 bp, Homo sapiens
ggtgtgcgggggtctctgctgagcgaggctgatgtgcgggctctgggaggcctggcttgcgacctgcctgggcgctttgtggccgagtcggccgaagtgctgctaccccggctg

SEQ ID NO: 51 - DNA, 80 bp, Homo sapiens
gtgagctgcccgggacccctggaccaggaccagcaggaggcagccagggcggctctgcagggcgggggacccccctacgg

SEQ ID NO: 52 - DNA, 91 bp, Homo sapiens
ccccccgtcgacatggtctgtctccacgatggacgctctgcggggcctgctgcccgtgctgggccagcccatcatccgcagcatcccgcag

SEQ ID NO: 53 - DNA, 100 bp, Homo sapiens
ggcatcgtggccgcgtggcggcaacgctcctctcgggacccatcctggcggcagcctgaacggaccatcctccggccgcggttccggcgggaagtggaga

SEQ ID NO: 54 - DNA, 30 bp, Homo sapiens
gtggccaccctgatcgaccgctttgtgaag

SEQ ID NO: 55 - DNA, 74 bp, Homo sapiens
ggaaggggccagctagacaaagacaccctagacaccctgaccgccttctaccctgggtacctgtgctccctcag

SEQ ID NO: 56 - DNA, 39 bp, Homo sapiens
ccccgaggagctgagctccgtgccccccagcagcatctg

SEQ ID NO: 57 - DNA, 74 bp, Homo sapiens
gtgagtccccagaactctgcccggcaaggtgggtccgtgtgctggcgctcactgtccacccaccgtgtccccag

SEQ ID NO: 58 - DNA, 43 bp, Homo sapiens
ggcggtcaggccccaggacctggacacgtgtgacccaaggcag

SEQ ID NO: 59 - DNA, 21 bp, Homo sapiens
ctggacgtcctctatcccaag

SEQ ID NO: 60 - DNA, 18 bp, Homo sapiens
gcccgccttgctttccag

SEQ ID NO: 61 - DNA, 30 bp, Homo sapiens
aacatgaacgggtccgaatacttcgtgaag

SEQ ID NO: 62 - DNA, 12 bp, Homo sapiens
atccagtccttc

SEQ ID NO: 63 - DNA, 4 bp, Homo sapiens
ctgg

SEQ ID NO: 64 - DNA, 38 bp, Homo sapiens
gtggggcccccacggaggatttgaaggcgctcagtcag

SEQ ID NO: 65 - DNA, 57 bp, Homo sapiens
cagaatgtgagcatggacttggccacgttcatgaagctgcggacggatgcggtgctg

SEQ ID NO: 66 - DNA, 24 bp, Homo sapiens
ccgttgactgtggctgaggtgcag

SEQ ID NO: 67 - DNA, 33 bp, Homo sapiens
aaacttctgggaccccacgtggagggcctgaag

SEQ ID NO: 68 - DNA, 51 bp, Homo sapiens
gcggaggagcggcaccgcccggtgcgggactggatcctacggcagcggcag

SEQ ID NO: 69 - DNA, 79 bp, Homo sapiens
gacgacctggacacgctggggctggggctacagggcggcatccccaacggctacctggtcctagacctcagcatgcaag

SEQ ID NO: 70 - DNA, 30 bp, Homo sapiens
aggccctctcggggacgccctgcctcctag

SEQ ID NO: 71 - protein, 628 aa, Homo sapiens
MALQRLDPCWSCGDRPGSLLFLLFSLGWVHPARTLAGETGTESAPLGGVLTTPHNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVDKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSVQETLSGTPCLLGPGPVLTVLALLLASTLA

SEQ ID NO: 72 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAPEIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 73 - protein, 630 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 74 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSVQEALSGTPCLLGPGPVLTVLALLLASTLA

SEQ ID NO: 75 - protein, 621 aa, Homo sapiens [sequence omitted]

SEQ ID NO: 76 - protein, 630 aa, Homo sapiens; identical to SEQ ID NO: 73

SEQ ID NO: 77 - protein, 398 aa, Homo sapiens
VEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSVQGGRGGQARAGGRAGGVEVGALSHPSLCRGPLGDALPPRTWTCSHRPGTAPSLHPGLRAPLPCWPQPCWGSPPGQEQARVIPVPPQENSRSVNGNMPPADT

SEQ ID NO: 78 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 79 - protein, 622 aa, Homo sapiens; identical to SEQ ID NO: 78

SEQ ID NO: 80 - protein, 458 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIW

SEQ ID NO: 81 - protein, 565 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 82 - protein, 527 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 83 - protein, 547 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 84 - protein, 457 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 85 - DNA, 2092 bp, Homo sapiens
cgccccacgccgcgcgggaacccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggagaagacttcatggcggcggctatggttgccttctgataattgaaggatccctagtggaataaggaacgaatttattgcagacattgtaagcaagaacaactggtaaatgttataggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaata

SEQ ID NO: 86 - DNA, 1151 bp, Homo sapiens
cgccccacgccgcgcgggaacccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggagaagacttcatggcggcggctatggttgccttctgataattgaaggatccctagtggaataaggaacgaatttattgcagacattgtaagcaagaacaactggtaaatgttataggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacg

SEQ ID NO: 87 - DNA, 2029 bp, Homo sapiens
cgccccacgccgcgcgggaacccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagctggctccagaagaatgatcagattccggtttgattcctttgacaaaactatagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaata

SEQ ID NO: 88 - DNA, 1362 bp, Homo sapiens
cgccccacgccgcgcgggaacccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcaacggggtttcaccgtattagccaggatggtctcgatctcctgacctcgtgatccgcctgcctcagcctcccaaagtgttggacaggcatgagccaccgtgcccagcccttaaccctgttttaggtctttattacattggcctgaagttccaagacttggttaaacaagagacgtgtcgttgtcttgaaatgactctggtattaatatttttacagttagggatgatggcagctgttggatttagagaaagattattattttattctgtttctgctttacaaaaaataggaatggcttctgaattttatgagatgctattgtaacatttagatgatgatatggttttcttcttttaactattgctgaggatatgtaatagtaaatttgctattaatcaaaggtatcacaaggtatatatcgtgaataaccaaaatcccactcatattagtcctgcgtacggaatttattgaaaggttagaggagaatctcatataaatttagattaataagaataggccgggcacagtgg

SEQ ID NO: 89 - DNA, 2155 bp, Homo sapiens
cgccccacgccgcgcgggaacccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacaggaactccaaatatatgtatactagactacttgatattgtttaaaggccatggaggcggttccttttttctccctggtcttttttcctctctgtgcttcagtgtgggtagtttctgttgctgtgtctccaagtcactgatcttttcttcttcagcatctaatggcttttaattacatctggagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaata

SEQ ID NO: 90 - DNA, 1066 bp, Homo sapiens
cgccccacgccgcgcgggaacccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggagaagacttcatggcggcggctatggttgccttctgataattgaaggatccctagtggaataaggaacgaatttattgcagacattgtaagcaagaacaactggtaaatgttataggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaaggtgagggctgcaagtgttttctaagggttgaaacatcagaataaaggtatggtggcaagtcctccttctgctaggctggctggcaaggccctatgtcttgacctaggtggtagttacaagggtatttatttgccttataataattcactaaactatgtatttgagtagatttttatgtgtgtgctttaatttacaataaaaaagttaaaaagaaaca

SEQ ID NO: 91 - DNA, 2601 bp, Homo sapiens
cgccccacgccgcgcgggaacccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggtaaggggggcggggcttggggggccagagcgtgggagcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatgtaggactccgtggcaaactgctagttgttcgtgcaagtagtagttggcaaactgcttgtactactgagacgggcaagtgcgggaataattacaataaagggcataagggccatgtgttctgaaattattttgaggcaagaagttttgaaagatggtttccacagttgattctaaatgaccaagctgtttccaaaaaagaaattatcttcaaaagatgaatatttgcccatattgaagatctttaaaagtctggtaaaaaggtgtggaaactgttccttaagaaaacttgcccaaactgaagcttcgcaagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaata

SEQ ID NO: 92 - DNA, 1821 bp, Homo sapiens
acagcaaggaggtagcccagccccgcgttcggctgctctcgaggaggccggagcccccggagacgatgcgccccgcgcagccgcctgcgcctgcgggagccggctgcccttgagatggagttgctgcctctttggctctgcctgggttttcacttcctgaccgtgggctggaggaacagaagcggaacagccacagcagcctcccaaggagtctgcaagttgagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaata

SEQ ID NO: 93 - DNA, 121 bp, Homo sapiens
ggctgcccttgagatggagttgctgcctctttggctctgcctgggttttcacttcctgaccgtgggctggaggaacagaagcggaacagccacagcagcctcccaaggagtctgcaagttg

SEQ ID NO: 94 - DNA, 312 bp, Homo sapiens
cgccccacgccgcgcgggaacccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccg

SEQ ID NO: 95 - DNA, 480 bp, Homo sapiens
gtaaggggggcggggcttggggggccagagcgtgggagcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatgtaggactccgtggcaaactgctagttgttcgtgcaagtagtagttggcaaactgcttgtactactgagacgggcaagtgcgggaataattacaataaagg

SEQ ID NO: 96 - DNA, 146 bp, Homo sapiens
ttgattctaaatgaccaagctgtttccaaaaaagaaattatcttcaaaagatgaatatttgcccatattgaagatctttaaaagtctggtaaaaaggtgtggaaactgttccttaagaaaacttgcccaaactgaagcttcgcaag

SEQ ID NO: 97 - DNA, 180 bp, Homo sapiens
gaactccaaatatatgtatactagactacttgatattgtttaaaggccatggaggcggttccttttttctccctggtcttttttcctctctgtgcttcagtgtgggtagtttctgttgctgtgtctccaagtcactgatcttttcttcttcagcatctaatggcttttaattacatctgg

SEQ ID NO: 98 - DNA, 142 bp, Homo sapiens
agaccttttaatcaaagtgaagtttggggaaagcattgaggacttgcacacctgccgtctcttaattaaacaggacattcctgcaggactttatgtggatccgtatgagttggcttcattacgagagagaaacataacagag

SEQ ID NO: 99 - DNA, 214 bp, Homo sapiens
gcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaag

SEQ ID NO: 100 - DNA, 217 bp, Homo sapiens
gtgagggctgcaagtgttttctaagggttgaaacatcagaataaaggtatggtggcaagtcctccttctgctaggctggctggcaaggccctatgtcttgacctaggtggtagttacaagggtatttatttgccttataataattcactaaactatgtatttgagtagatttttatgtgtgtgctttaatttacaataaaaaagttaaaaagaaaca

SEQ ID NO: 101 - DNA, 2541 bp, Homo sapiens
gtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctcaaaaaaaaaaaaaaaaaaaaaaaaaaaaaagtaaataaaaccttagggcaagcatgttccaaaacagaagacatcaaaccagggtgtgttggcattatttattttatgtagagtattgagatgtgataaacctttgtatatgccatcactgctccatttcctaaagtattttggtgttttcatgggactacatcttgtataatttgacatgtatgacctgactagtcctaacagttctttttaaacgtgtatttgagacttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgtaataaaaatgtgaatgaagaaaactttgatataactcttcttgcttagataaatggttgcagatgacatcacttttagtataacagaacatttctggttttgtttgtattatcttgtaaacatggccaacatggtgaaaccccatctctactaaaaatacaaaaaattagccgggagtggtggcatgcggctgtaatcccagctactcgggaggccgaggcaggagaatcacttgaacccgggaggcagaggttgcagtgagccgagatcgtaccactgcaccccagcctgggcgacagagtgagactccgtcac

SEQ ID NO: 102 - DNA, 529 bp, Homo sapiens
acggggtttcaccgtattagccaggatggtctcgatctcctgacctcgtgatccgcctgcctcagcctcccaaagtgttggacaggcatgagccaccgtgcccagcccttaaccctgttttaggtctttattacattggcctgaagttccaagacttggttaaacaagagacgtgtcgttgtcttgaaatgactctggtattaatatttttacagttagggatgatggcagctgttggatttagagaaagattattattttattctgtttctgctttacaaaaaataggaatggcttctgaattttatgagatgctattgtaacatttagatgatgatatggttttcttcttttaactattgctgaggatatgtaatagtaaatttgctattaatcaaaggtatcacaaggtatatatcgtgaataaccaaaatcccactcatattagtcctgcgtacggaatttattgaaaggttagaggagaatctcatataaatttagattaataagaataggccgggcacagtgg

SEQ ID NO: 103 - DNA, 101 bp, Homo sapiens
acagcaaggaggtagcccagccccgcgttcggctgctctcgaggaggccggagcccccggagacgatgcgccccgcgcagccgcctgcgcctgcgggagcc

SEQ ID NO: 104 - DNA, 64 bp, Homo sapiens
gcataagggccatgtgttctgaaattattttgaggcaagaagttttgaaagatggtttccacag

SEQ ID NO: 105 - DNA, 117 bp, Homo sapiens
gagaagacttcatggcggcggctatggttgccttctgataattgaaggatccctagtggaataaggaacgaatttattgcagacattgtaagcaagaacaactggtaaatgttatag

SEQ ID NO: 106 - DNA, 54 bp, Homo sapiens
ctggctccagaagaatgatcagattccggtttgattcctttgacaaaactatag

SEQ ID NO: 107 - DNA, 101 bp, Homo sapiens
agttcccgattttgaaatgctgggctcactcagaagtggcagccccttgtgctttggagaatgaggatatctgccaatggaacaagatgaagtataaatca

SEQ ID NO: 108 - protein, 217 aa, Homo sapiens
MCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQEFPILKCWAHSEVAAPCALDNEDICQWNKMKYKSVYKNVILQVPVGLTVHTSLVCSVTLLITILCSTLILVAVFKYGHFSL

SEQ ID NO: 109 - protein, 217 aa, Homo sapiens; identical to SEQ ID NO: 108

SEQ ID NO: 110 - protein, 225 aa, Homo sapiens
MCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQAGSRRMIRFRFDSFDKTIEFPILKCWAHSEVAAPCALENEDICQWNKMKYKSVYKNVILQVPVGLTVHTSLVCSVTLLITILCSKKKKK

SEQ ID NO: 111 - protein, 150 aa, Homo sapiens [sequence omitted]

SEQ ID NO: 112 - protein, 235 aa, Homo sapiens
MCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQAGSRRMIRFRFDSFDKTIEFPILKCWAHSEVAAPCALENEDICQWNKMKYKSVYKNVILQVPVGLTVHTSLVCSVTLLITILCSTLILVAVFKYGHFSL

SEQ ID NO: 113 - protein, 186 aa, Homo sapiens
MCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQEFPILKCWAHSEVAAPCALENEDICQWNKMKYKSTGFHRISQDGLDLLTS

SEQ ID NO: 114 - protein, 79 aa, Homo sapiens
MCSEIILRQEVLKDGFHRDLLIKVKFGESIEDLHTCRLLIKQDIPAGLYVDPYELASLRERNITEEKTSWRRLWLPSDN

SEQ ID NO: 115 - DNA, 2706 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatggtgagtgagcccacatatagatgaccccagacattagggaacaggccccagcctaatttgtaatcccctagagtctgagggtgtcttcaccaccacagtgactgggagaggatgaggaggaacgtctaaggttgcaggggcctctgtaggatccccaatcctccttcttagtccctggaaggatgtttctccacctttctttgctgataccctcctctcttcactgttccactcccttgcttcctctggctgccagcagacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 116 - DNA, 2459 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagacttgggggtagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 117 - DNA, 2922 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaaggtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcagacttgggggtagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 118 - DNA, 2568 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggtaagaggaggaacagccgggtacctaggggaagagaccagaggtcagcggccaggctgtgattcccaaagccacacaggaccctcaaagaagccctctgccccatctcctctccctgcaggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 119 - DNA, 3181 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatggtgagtgagcccacatatagatgaccccagacattagggaacaggccccagcctaatttgtaatcccctagagtctgagggtgtcttcaccaccacagtgactgggagaggatgaggaggaacgtctaaggttgcaggggcctctgtaggatccccaatcctccttcttagtccctggaaggatgtttctccacctttctttgctgataccctcctctcttcactgttccactcccttgcttcctctggctgccagcagacacccccatgacccttccaaaaggtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcagacttgggggtagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 120 - DNA, 3157 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaaggtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcagacttgggggtagggtccacagaacaagatgctgcatcccctgagaaagagaagatgaacccgctggaacagtatgagcgaaaggtaagttagtcagaactgtgggctccctaaggggaacaagatcggggcctatatggctgggtacgagggaggagatgctgggggcttggattccttgtcctgagggaagagggagctgaggacgtggaattgagatcctagaaaatgagagggctgggggacgctctcttgggcccttgggtaggaagaagccagtgccaggcttctgggttcctgacacctcctgctcccccaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 121 - DNA, 2288 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 122 - DNA, 2376 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 123 - DNA, 2454 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccgtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaattcagtccagattcaagggaaggaacctatatgcataccggaaagtgtgacctattgcagcccccacatctattgtgtctttctcctggatatctcacacataaccctgattctcctagtatttaagaaagctatcatcttgaggcgcggtggctcacgcctataatcccagcactttaggaggccgaggcgggtggatcacttgaggtcaggagttcgagaccagcctggccaacatggtgaaaccccgtctttactaaaaatacaaaaatcagccgggcatgatgtcgcttgcctgtaatcccagctacttaggaggctgaggcaagagaattgcttgaacccgggaggtggaggttgcagtgagctgagatcgcatcattgcactccagctgggcaacaagagtgagactctgtctc

SEQ ID NO: 124 - DNA, 1786 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 125 - DNA, 4101 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgctcacatccttccagctcccaaatgcgccgctattcctcagacgcccgcgcctcaggctcttctcttgtcccttagaccctctttctgtctcttggaccccttcctatcccctgaacaccgcttctctgccccttcccagtctctcagctcagcttcctgaccctgaaacatggaccctcacatgctgtgtctttgacccctgcttcttggcccttggattcctactccccccgccgtcgatcctatgttctgtcccttggattttcactgcctttcccagaatcgtcttttttttttttttttttttgagacaggttcttgctctgtcgcccaggcaggagagcagtgtgcgatcttggctcattgcaacttccacctcctgggttcaagcaattctcctgcctcagcctctcgagtagctgggattacaggagcctgccaccacactgggctaatttttttttttttttttgacagagtctcgctctgtttcccaggctggagtgcagtgacatgatctgggctcactgcaacctccgcctactgggttcaagctattctcctgcctcagcctcctgagtagctgggactacaggcgggtgtcaccacatctggctgatttttgtatttttagtagagacagggtttcaccatactggtcaggctggtcttgaactcgacctcaggtgatccacccttggcctcctaaagtactcggattacaggtgtgagccaccacgcccggccccagctaatttttgtatttttggtagacacgggtttcagcatgttggccaggctggtcttgaactcctgacctcaggtgatctgcctgccttggcctcccaaagtgctgggattacaggcgtgagccaccatgcccagccagaaaccccaataacttttgcaccaatctaatatttttagcagagacagggttttgccatgttgcccaggctggtctcgaactcctgacctcaggtgatctgcccacctcggcctcccaaagtgctgggattacaggcgtgagccaccatgcccggccagaaaccccaataacttgcaccaatctaatatttttagcagagacagggttttgccatgttgcccaggctagtctcaaactcctgacctcaggtgatctgcctacctcggcctcccaaagtgctgggattacaggcatgagccaccgcgcccggtcgagaatctccttcttgttccttgaaccctcttcctgtccctcaacctcctttctccataacttcacttgttttccctggaacccctgttctgtgcgctcaaatttgaattcccctttcctggatgttttcttcctgtctatgaaactccattctgtgctcttgaactccaaatcttgccttgaaccatgtcatttctatatgaccctccaatcctcaatctctgtctctggaatcccctcaaaccccactttctgttccttggactttattcttcaatttccttctcctatggcccagttcctaacccttgtaccacacatcctgtccattgcatgtgccgcttttcctcagtcgctattgaattcctccttcatactgcttcagtttcctcatctccagcctgcattgcgcagttcatccttcatgtccactcacccacaggtgcatacccaccttcaagtgattgaggagagggtgaatcagagcctgggcctgcttgaccagaacccccacctggctcaggagctgcggccccaaatccgtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaattcagtccagattcaagggaaggaacctatatgcataccggaaagtgtgacctattgcagcccccacatctattgtgtctttctcctggatatctcacacataaccctgattctcctagtatttaagaaagctatcatcttgaggcgcggtggctcacgcctataatcccagcactttaggaggccgaggcgggtggatcacttgaggtcaggagttcgagaccagcctggccaacatggtgaaaccccgtctttactaaaaatacaaaaatcagccgggcatgatgtcgcttgcctgtaatcccagctacttaggaggctgaggcaagagaattgcttgaacccgggaggtggaggttgcagtgagctgagatcgcatcattgcactccagctgggcaacaagagtgagactctgtctc

SEQ ID NO: 126 - DNA, 133 bp, Homo sapiens
atgtacccggagctgcagattgcacgtgtggagcaggctacgcaggccatccccatggagcgctggtgcgggggttcccggagcggcagctgcgcccacccccaccaccaggttgtgcccttccgctgcctgc

SEQ ID NO: 127 - DNA, 134 bp, Homo sapiens
gcctgcagctcccagggcctcatcctgcacggctcgggcatgctcttaccctgtggctcggatcggttccgtggtgtggagtatgtgtgctgtccccctccagggacccccgacccatctgggacagcagttgg

SEQ ID NO: 128 - DNA, 131 bp, Homo sapiens
tcactcccaccccgaggcccacagacggtgtggatatttactttggcatgcctggggaaatcagtgagcacgaggggttcctgagggccaagatggacctggaggagcgtaggatgcgccagattaatgag

SEQ ID NO: 129 - DNA, 159 bp, Homo sapiens
cacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcag

SEQ ID NO: 130 - DNA, 129 bp, Homo sapiens
gcggagcgtgtcctgttggccctgcggcgctacctgcgtgcggagcagaaggaacagaggcacacgctgcgccactaccagcatgtggccgccgtggatcccgagaaggcacagcagatgcgcttccag

SEQ ID NO: 131 - DNA, 1643 bp, Homo sapiens
tcacatccttccagctcccaaatgcgccgctattcctcagacgcccgcgcctcaggctcttctcttgtcccttagaccctctttctgtctcttggaccccttcctatcccctgaacaccgcttctctgccccttcccagtctctcagctcagcttcctgaccctgaaacatggaccctcacatgctgtgtctttgacccctgcttcttggcccttggattcctactccccccgccgtcgatcctatgttctgtcccttggattttcactgcctttcccagaatcgtcttttttttttttttttttttgagacaggttcttgctctgtcgcccaggcaggagagcagtgtgcgatcttggctcattgcaacttccacctcctgggttcaagcaattctcctgcctcagcctctcgagtagctgggattacaggagcctgccaccacactgggctaatttttttttttttttttgacagagtctcgctctgtttcccaggctggagtgcagtgacatgatctgggctcactgcaacctccgcctactgggttcaagctattctcctgcctcagcctcctgagtagctgggactacaggcgggtgtcaccacatctggctgatttttgtatttttagtagagacagggtttcaccatactggtcaggctggtcttgaactcgacctcaggtgatccacccttggcctcctaaagtactcggattacaggtgtgagccaccacgcccggccccagctaatttttgtatttttggtagacacgggtttcagcatgttggccaggctggtcttgaactcctgacctcaggtgatctgcctgccttggcctcccaaagtgctgggattacaggcgtgagccaccatgcccagccagaaaccccaataacttttgcaccaatctaatatttttagcagagacagggttttgccatgttgcccaggctggtctcgaactcctgacctcaggtgatctgcccacctcggcctcccaaagtgctgggattacaggcgtgagccaccatgcccggccagaaaccccaataacttgcaccaatctaatatttttagcagagacagggttttgccatgttgcccaggctagtctcaaactcctgacctcaggtgatctgcctacctcggcctcccaaagtgctgggattacaggcatgagccaccgcgcccggtcgagaatctccttcttgttccttgaaccctcttcctgtccctcaacctcctttctccataacttcacttgttttccctggaacccctgttctgtgcgctcaaatttgaattcccctttcctggatgttttcttcctgtctatgaaactccattctgtgctcttgaactccaaatcttgccttgaaccatgtcatttctatatgaccctccaatcctcaatctctgtctctggaatcccctcaaaccccactttctgttccttggactttattcttcaatttccttctcctatggcccagttcctaacccttgtaccacacatcctgtccattgcatgtgccgcttttcctcagtcgctattgaattcctccttcatactgcttcagtttcctcatctccagcctgcattgcgcagttcatccttcatgtccactcacccacag

SEQ ID NO: 132 - DNA, 872 bp, Homo sapiens
gtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaattcagtccagattcaagggaaggaacctatatgcataccggaaagtgtgacctattgcagcccccacatctattgtgtctttctcctggatatctcacacataaccctgattctcctagtatttaagaaagctatcatcttgaggcgcggtggctcacgcctataatcccagcactttaggaggccgaggcgggtggatcacttgaggtcaggagttcgagaccagcctggccaacatggtgaaaccccgtctttactaaaaatacaaaaatcagccgggcatgatgtcgcttgcctgtaatcccagctacttaggaggctgaggcaagagaattgcttgaacccgggaggtggaggttgcagtgagctgagatcgcatcattgcactccagctgggcaacaagagtgagactctgtctc

SEQ ID NO: 133 - DNA, 256 bp, Homo sapiens
gtgagtgagcccacatatagatgaccccagacattagggaacaggccccagcctaatttgtaatcccctagagtctgagggtgtcttcaccaccacagtgactgggagaggatgaggaggaacgtctaaggttgcaggggcctctgtaggatccccaatcctccttcttagtccctggaaggatgtttctccacctttctttgctgataccctcctctcttcactgttccactcccttgcttcctctggctgccag

SEQ ID NO: 134 - DNA, 463 bp, Homo sapiens
gtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcag

SEQ ID NO: 135 - DNA, 235 bp, Homo sapiens
gtaagttagtcagaactgtgggctccctaaggggaacaagatcggggcctatatggctgggtacgagggaggagatgctgggggcttggattccttgtcctgagggaagagggagctgaggacgtggaattgagatcctagaaaatgagagggctgggggacgctctcttgggcccttgggtaggaagaagccagtgccaggcttctgggttcctgacacctcctgctcccccag

SEQ ID NO: 136 - DNA, 121 bp, Homo sapiens
gtaagaggaggaacagccgggtacctaggggaagagaccagaggtcagcggccaggctgtgattcccaaagccacacaggaccctcaaagaagccctctgccccatctcctctccctgcag

SEQ ID NO: 137 - DNA, 144 bp, Homo sapiens
gcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggag

SEQ ID NO: 138 - DNA, 298 bp, Homo sapiens
aaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 139 - DNA, 116 bp, Homo sapiens
ggggcggggctggcggcgccggcgcagcccgggggcggcgggaggaggaggtggcggcggtggcgctgggagctcctgtcaccgctggggccgggccgggcgggagtgcaggggac

SEQ ID NO: 140 - DNA, 41 bp, Homo sapiens
gtgagggcgcaagggccgggacatggggcccgccagccccg

SEQ ID NO: 141 - DNA, 44 bp, Homo sapiens
ctgctcgcggtctaagtcgccgcccgggccagccgccgctgccg

SEQ ID NO: 142 - DNA, 84 bp, Homo sapiens
ctgctgctgccactattgctgctgcttctgcgcgcgcagcccgccatcgggagcctggccggtgggagccccggcgcggccgag

SEQ ID NO: 143 - DNA, 82 bp, Homo sapiens
gccccggggtcggcccaggtggctggactatgcgggcgcctaacccttcaccgggacctgcgcaccggccgctgggaaccag

SEQ ID NO: 144 - DNA, 62 bp, Homo sapiens
acccacagcgctctcgacgctgtctccgggacccgcagcgcgtgctggagtactgcagacag

SEQ ID NO: 145 - DNA, 16 bp, Homo sapiens
ctggtgaatttgtgag

SEQ ID NO: 146 - DNA, 97 bp, Homo sapiens
tgaggccctgctggtgcctgaaggctgccggttcttgcaccaggagcgcatggaccaatgtgagagttcaacccggaggcatcaggaggcacaggag

SEQ ID NO: 147 - DNA, 58 bp, Homo sapiens
tgacccctccacccggtcctggcccccggggagcagagtagagggggctgaggacgag

SEQ ID NO: 148 - DNA, 57 bp, Homo sapiens
gaagaggaggaatccttcccacagccagtagatgattacttcgtggagcctccgcag

SEQ ID NO: 149 - DNA, 64 bp, Homo sapiens
gctgaagaggaagaggaaacggtcccacccccaagctcccatacacttgcagtggtcggcaaag

SEQ ID NO: 150 - DNA, 75 bp, Homo sapiens
gtgatgcgtgaatgggccatggcagacaaccagtccaagaacctgcctaaagccgacagacaggccctgaatgag

SEQ ID NO: 151 - DNA, 4 bp, Homo sapiens
gtgc

SEQ ID NO: 152 - DNA, 72 bp, Homo sapiens
gtgcatacccaccttcaagtgattgaggagagggtgaatcagagcctgggcctgcttgaccagaacccccac

SEQ ID NO: 153 - DNA, 28 bp, Homo sapiens
ctggctcaggagctgcggccccaaatcc

SEQ ID NO: 154 - DNA, 108 bp, Homo sapiens
aggaactcctccactctgaacacctgggtcccagtgaattggaagcccctgcccctgggggcagcagcgaggacaagggtgggctgcagcctccagattccaaggatg

SEQ ID NO: 155 - DNA, 3 bp, Homo sapiens
cag

SEQ ID NO: 156 - DNA, 24 bp, Homo sapiens
acacccccatgacccttccaaaag

SEQ ID NO: 157 - DNA, 12 bp, Homo sapiens
acttgggggtag

SEQ ID NO: 158 - DNA, 9 bp, Homo sapiens
ggtccacag

SEQ ID NO: 159 - DNA, 62 bp, Homo sapiens
aacaagatgctgcatcccctgagaaagagaagatgaacccgctggaacagtatgagcgaaag

SEQ ID NO: 160 - DNA, 63 bp, Homo sapiens
gtgaatgcgtctgttccaaggggtttccctttccactcatcggagattcagagggatgagctg

SEQ ID NO: 161 - DNA, 36 bp, Homo sapiens
gtggaccccatgctgaccctggaggagcagcagctc

SEQ ID NO: 162 - DNA, 39 bp, Homo sapiens
cgcgaactgcagcggcacggctatgagaaccccacttac

SEQ ID NO: 163 - DNA, 59 bp, Homo sapiens
cgcttcctggaggaacgaccctgacccggcccccttcaccccttcagccgagcccagac

SEQ ID NO: 164 - DNA, 17 bp, Homo sapiens
ctcccctcttcctggag

SEQ ID NO: 165 - DNA, 6 bp, Homo sapiens
ccccag

SEQ ID NO: 166 - protein, 650 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 167 - protein, 650 aa, Homo sapiens; identical to SEQ ID NO: 166

SEQ ID NO: 168 - protein, 204 aa, Homo sapiens
MSHRARSRISFLFLEPSSCPSTSFLHNFTCFPWNPCSVRSNLNSPFLDVFFLSMKLHSVLLNSKSCLEPCHFYMTLQSSISVSGIPSNPTFCSLDFILQFPSPMAQFLTLVPHILSIACAAFPQSLLNSSFILLQFPHLQPALRSSSFMSTHPQVHTHLQVIEERVNQSLGLLDQNPHLAQELRPQIRECLLPWLPLQISEGRS

SEQ ID NO: 169 - protein, 519 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDGE

SEQ ID NO: 170 - protein, 654 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKDLGVGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 171 - protein, 541 aa, Homo sapiens [sequence omitted]

SEQ ID NO: 172 - protein, 619 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELVRGGTAGYLGEETRGQRPGCDSQSHTGPSKKPSAPSPLPAGTSWDRGVP

SEQ ID NO: 173 - protein, 597 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 174 - protein, 544 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGECVCSKGFPFPLIGDSEG

SEQ ID NO: 175 - protein, 498 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIRECLLPWLPLQISEGRS

SEQ ID NO: 176 - protein, 505 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQPQNPNSQPRAAGSLEVIISHPFVRRLEILISPFQFQNSIPKNSQIVPAASPRGTSSP

SEQ ID NO: 177 - protein, 588 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVLTSFQLPNAPLFLRRPRLRLFSCPLDPLSVSWTPSYPLNTASLPLPSLSAQLPDPETWTLTCCVFDPCFLALGFLLPPPSILCSVPWIFTAFPRIVFFFFFFLRQVLALSPRQESSVRSWLIATSTSWVQAILLPQPLE

SEQ ID NO: 178 - DNA, 1774 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaagtaaggaacgggagacacagtcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggcca

SEQ ID NO: 179 - DNA, 1767 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaagtcttctcctaagtcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggcca

SEQ ID NO: 180 - DNA, 1827 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctgggaaaagtaacggatccagttggccaacaccacaaggttcgtgcaaaaggcgaagtgatcaggaatcagtcaagccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggcca

SEQ ID NO: 181 - DNA, 1769 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagatcccctccttgcagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggcca

SEQ ID NO: 182 - DNA, 1745 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggcca

SEQ ID NO: 183 - DNA, 1457 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaacta

SEQ ID NO: 184 - DNA, 1635 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagggtgagaaaggaagatctcttgagctcaggagttcaagatcagcctgggcaacacagtgagacctcatctccactaaaaataaaaaaaaattggctgga

SEQ ID NO: 185 - DNA, 2077 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagggtgagaaaggaagatctcttgagctcaggagttcaagatcagcctgggcaacacagtgagacctcatctccactaaaaataaaaaaaaattggctggatgtggtggggcatgcctgtggtcctagttacatgggaggctgaggcaggaggatcccttgagcccgggaggtcaaggctgcagtgagccatgatcccaccactgtactccagcctgggcaacagagccagactctgtctccaaaaaaaaaacactaaaacccaaaaccatattacatatgtcctgtaaatatacaccactattatgtattcataatacttaaaaataaaaaattaaaaacacacacacacaaatcttacaagcaaggtggcttaaaaccacagaaacttggccgggtttggtggctcatgcctgtaatcccagcaattcgggaggctgaggcgggcggatcacgaggtcaggagatcgagaccatcctggctaacatgatgaaaccctgtcactattaaaaatacaaaaaattaactgggcgtggtggtggg

SEQ ID NO: 186 - DNA, 1941 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagggctgaggcaggaggatcccttgagcccgggaggtcaaggctgcagtgagccatgatcccaccactgtactccagcctgggcaacagagccagactctgtctccaaaaaaaaaacactaaaacccaaaaccatattacatatgtcctgtaaatatacaccactattatgtattcataatacttaaaaataaaaaattaaaaacacacacacacaaatcttacaagcaaggtggcttaaaaccacagaaacttggccgggtttggtggctcatgcctgtaatcccagcaattcgggaggctgaggcgggcggatcacgaggtcaggagatcgagaccatcctggctaacatgatgaaaccctgtcactattaaaaatacaaaaaattaactgggcgtggtggtggg

SEQ ID NO: 187 - DNA, 1546 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacggatgtggacatttttgccatggaaaagtggaattccggctgggtgcggtggctgaagcttgtactctcagcactttgggaggctgaggccggaggatctcttgaggccaggagtttgagaccagcctgggcaacatagcaagacccccatctctacaaaaagaaaaatggaattctttggtggatttctcgtgggttgtggggatttgctgaagacatcttgggctttcatcctgtggtgtcctggaaaggtctctgtattccagtggttctcaaactttttggtctcaacttcttcatgcttttaaaaattatttttggccaggtgtggtggctcacgcctgtaattgcaacaccttgggaggg

SEQ ID NO: 188 - DNA, 1607 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaaaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggcca

SEQ ID NO: 189 - DNA, 1627 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaagtaaggaacgggagacacagaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggcca

SEQ ID NO: 190 - DNA, 1610 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaaggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggcca

SEQ ID NO: 191 - DNA, 1967 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctgggcgacagcgcgagactccatttcaaaaaaaaaaaaagaaaaaagaaagaaaggagaaacttgaggcgctacaatctctgaaataacagaagtgtagaatttgggttccacagacaacctggctttttcccggagcgcacttgccaatctgctgctgtggaagggaaatagagcccagacggaaagagagtcgctagactgagaagacggaggttggagtttggggctgccagaatgtctggaagatgagagttaaaatcctggaatggatgggaccacagaaaagggagttcccaacctgcaaacaaatctccctcaagtcattggcaagctctacatgcacagggtgagagtccaagaaacttggaagagaaaaatagcaactgggaagctacaaaagcgaacaaggcttccagcagacatgtgatgctggggacacaggttgccaagctgaagaggccttggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggcca

SEQ ID NO: 192 - DNA, 1171 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaaggtgagcttccccccaacccacacacccctccagcgcagcatggaacgcgagtgattgagaaaccttcctcaccagtaactgggacatgcaaactaaaaacaaacaaacaaggagagcccatttcacacccaccagattggcaagcatttaaaaatctgacaatacccgggttagtaaggatgtggagttgcagaccgtgtctgtggtgggggagtaaattggcacatcaaccacttagagcgattcggcaatatctagtccagatgaagattaacatatgctacagctcaactcctcgccatgcagaaatgccaaagaaccttggccacatatacccagggacacatgtatacgaatgttcttagcagcaatgtttgtgacatggaaaattggaaacaggctgggcactggctcacacctgtatttccagcactttgggaggcagaggcggatgaattgcttgaggtcaggagttcaagaccaggctggccaacatggtgaaacacccgtctccacacacacacaaaaaaggaaaaattagccgagtgtggtggcacgcacctgtaatctcagctact

SEQ ID NO: 193 - DNA, 482 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccag

SEQ ID NO: 194 - DNA, 578 bp, Homo sapiens
gtgagcttccccccaacccacacacccctccagcgcagcatggaacgcgagtgattgagaaaccttcctcaccagtaactgggacatgcaaactaaaaacaaacaaacaaggagagcccatttcacacccaccagattggcaagcatttaaaaatctgacaatacccgggttagtaaggatgtggagttgcagaccgtgtctgtggtgggggagtaaattggcacatcaaccacttagagcgattcggcaatatctagtccagatgaagattaacatatgctacagctcaactcctcgccatgcagaaatgccaaagaaccttggccacatatacccagggacacatgtatacgaatgttcttagcagcaatgtttgtgacatggaaaattggaaacaggctgggcactggctcacacctgtatttccagcactttgggaggcagaggcggatgaattgcttgaggtcaggagttcaagaccaggctggccaacatggtgaaacacccgtctccacacacacacaaaaaaggaaaaattagccgagtgtggtggcacgcacctgtaatctcagctact

SEQ ID NO: 195 - DNA, 141 bp, Homo sapiens
gagaagagctggagctggtggagaaaagctgtacccactcagagaagaccaacaggaccctgagctatcggactggcttgaagatcaccagccttaccgaggttgtgtgtgggttagacttgtgcaaccagggcaactctg

SEQ ID NO: 196 - DNA, 468 bp, Homo sapiens
cctgggcgacagcgcgagactccatttcaaaaaaaaaaaaagaaaaaagaaagaaaggagaaacttgaggcgctacaatctctgaaataacagaagtgtagaatttgggttccacagacaacctggctttttcccggagcgcacttgccaatctgctgctgtggaagggaaatagagcccagacggaaagagagtcgctagactgagaagacggaggttggagtttggggctgccagaatgtctggaagatgagagttaaaatcctggaatggatgggaccacagaaaagggagttcccaacctgcaaacaaatctccctcaagtcattggcaagctctacatgcacagggtgagagtccaagaaacttggaagagaaaaatagcaactgggaagctacaaaagcgaacaaggcttccagcagacatgtgatgctggggacacaggttgccaagctgaagaggccttg

SEQ ID NO: 197 - DNA, 153 bp, Homo sapiens
gccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaag

SEQ ID NO: 198 - DNA, 135 bp, Homo sapiens
ggcgtccaaaggatgaccgccacctccgtggctgtggctaccttcccggctgcccgggctccaatggtttccacaacaacgacaccttccacttcctgaaatgctgcaacaccaccaaatgcaacgagggcccaa

SEQ ID NO: 199 - DNA, 365 bp, Homo sapiens
gatgtggacatttttgccatggaaaagtggaattccggctgggtgcggtggctgaagcttgtactctcagcactttgggaggctgaggccggaggatctcttgaggccaggagtttgagaccagcctgggcaacatagcaagacccccatctctacaaaaagaaaaatggaattctttggtggatttctcgtgggttgtggggatttgctgaagacatcttgggctttcatcctgtggtgtcctggaaaggtctctgtattccagtggttctcaaactttttggtctcaacttcttcatgcttttaaaaattatttttggccaggtgtggtggctcacgcctgtaattgcaacaccttgggaggg

SEQ ID NO: 200 - DNA, 180 bp, Homo sapiens
aaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggcc

SEQ ID NO: 201 - DNA, 950 bp, Homo sapiens
tctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggccaggtatgcccttctttgtagtgtctatctttgggaggataaatggtgggggacaccttttcacaggctcctggaatcaggggtcatgtttgaggcccctgcctaggttggaagtcctcctgggggctgcctccacatctatttctggactccaaatgctgacagagcaggagcactgccatcttgaacaaacaccaccattcttagttcctcttgattaaaaatcggctaaatccggacgtggtggcgggtgcctgtagtcccagctattcgggaggctgaggcaggagaatggcgtcaatccgggaggtggagcttgcagtgagccgagattgcaccactgcactccagcctgggtgacagagcaagactctgtctcaaaaaaaaatcagctaaatccagccccaaaacatcagcctaatggctaccatcagcataaccagaaacattccaaccctaagataaacccctctctgaccagaaacatgccaacccccagatagcctcccttccgaccagagactttccaaccccacaataaacttttcctcacatgaaaacattccgaacctagataagcacccccttccaaaactcttaaatatccttagtctgta

SEQ ID NO: 202 - DNA, 356 bp, Homo sapiens
aacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagg

SEQ ID NO: 203 - DNA, 136 bp, Homo sapiens
gtgagaaaggaagatctcttgagctcaggagttcaagatcagcctgggcaacacagtgagacctcatctccactaaaaataaaaaaaaattggctggatgtggtggggcatgcctgtggtcctagttacatgggag

SEQ ID NO: 204 - DNA, 404 bp, Homo sapiens
gctgaggcaggaggatcccttgagcccgggaggtcaaggctgcagtgagccatgatcccaccactgtactccagcctgggcaacagagccagactctgtctccaaaaaaaaaacactaaaacccaaaaccatattacatatgtcctgtaaatatacaccactattatgtattcataatacttaaaaataaaaaattaaaaacacacacacacaaatcttacaagcaaggtggcttaaaaccacagaaacttggccgggtttggtggctcatgcctgtaatcccagcaattcgggaggctgaggcgggcggatcacgaggtcaggagatcgagaccatcctggctaacatgatgaaaccctgtcactattaaaaatacaaaaaattaactgggcgtggtggtggg

SEQ ID NO: 205 - DNA, 65 bp, Homo sapiens
cctcttggggcctgcggtgcatgcagtgtaagaccaacggggattgccgtgtggaagagtgcgcc

SEQ ID NO: 206 - DNA, 46 bp, Homo sapiens
ctgggacaggacctctgcaggaccacgatcgtgcgcttgtgggaag

SEQ ID NO: 207 - DNA, 15 bp, Homo sapiens
atcccctccttgcag

SEQ ID NO: 208 - DNA, 3 bp, Homo sapiens
aag

SEQ ID NO: 209 - DNA, 73 bp, Homo sapiens
ggaaaagtaacggatccagttggccaacaccacaaggttcgtgcaaaaggcgaagtgatcaggaatcagtcaa

SEQ ID NO: 210 - DNA, 9 bp, Homo sapiens
gtgaagaag

SEQ ID NO: 211 - DNA, 20 bp, Homo sapiens
gtaaggaacgggagacacag

SEQ ID NO: 212 - DNA, 13 bp, Homo sapiens
gtcttctcctaag

SEQ ID NO: 213 - DNA, 111 bp, Homo sapiens
tcctggagcttgaaaatctgccgcagaatggccgccagtgttacagctgcaaggggaacagcacccatggatgctcctctgaagagactttcctcattgactgccgaggcc

SEQ ID NO: 214 - DNA, 36 bp, Homo sapiens
ccatgaatcaatgtctggtagccaccggcactcacg

SEQ ID NO: 215 - DNA, 58 bp, Homo sapiens
ctgcccatctcagcctcaccatcaccctgctaatgactgccagactgtggggaggcac

SEQ ID NO: 216 - protein, 335 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 217 - protein, 335 aa, Homo sapiens; identical to SEQ ID NO: 216

SEQ ID NO: 218 - protein, 251 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTH

SEQ ID NO: 219 - protein, 281 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHERSLWGSWLPCKSTTALRPPCCEEAQATHV

SEQ ID NO: 220 - protein, 290 aa, Homo sapiens [sequence omitted]

SEQ ID NO: 221 - protein, 290 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEVLELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 222 - protein, 281 aa, Homo sapiens; identical to SEQ ID NO: 219

SEQ ID NO: 223 - protein, 301 aa, Homo sapiens [sequence omitted]

SEQ ID NO: 224 - protein, 335 aa, Homo sapiens; identical to SEQ ID NO: 216

SEQ ID NO: 225 - protein, 335 aa, Homo sapiens; identical to SEQ ID NO: 216

SEQ ID NO: 226 - protein, 247 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPSKERETQSWSLKICRRMAASVTAARGTAPMDAPLKRLSSLTAEAP

SEQ ID NO: 227 - protein, 210 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPSLLLSPGA

SEQ ID NO: 228 - protein, 340 aa, Homo sapiens
MGHPPLLPLLLLLHTCVPASWGLRCMQCKTNGDCRVEECALGQDLCRTTIVRLWEDPLLAEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 229 - protein, 332 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 230 - protein, 281 aa, Homo sapiens; identical to SEQ ID NO: 219

SEQ ID NO: 231 - protein, 279 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHGCGHFCHGKVEFRLGAVAEACTLSTLGG

SEQ ID NO: 232 - protein, 286 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPKPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 233 - protein, 217 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPSKERETQNRKTKAIW

SEQ ID NO: 234 - protein, 287 aa, Homo sapiens
MGHPPLLPLLLLLHTCVPASWGLRCMQCKTNGDCRVEECALGQDLCRTTIVRLWEGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 235 - protein, 176 aa, Homo sapiens
MGHPPLLPLLLLLHTCVPASWGLRCMQCKTNGDCRVEECALGQDLCRTTIVRLWEGELPPNPHTPPAQHGTRVIEKPSSPVTGTCKLKTNKQGEPISHPPDWQAFKNLTIPGLVRMWSCRPCLWWGSKLAHQPLRAIRQYLVQMKINICYSSTPRHAEMPKNLGHIYPGTHVYECS

SEQ ID NO: 236 - protein, 151 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGKSNGSSWPTPQGSCKRRSDQESVKPGCHLFPKPLPRMHFLWLIRHEL

SEQ ID NO: 237 - protein, 40 aa, Homo sapiens
MGHPPLLPLLLLLHTCVPAWATARDSISKKKKEKRKKGET

SEQ ID NO: 238 - DNA, 1370 bp, Homo sapiens
gaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccggttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccat

SEQ ID NO: 239 - DNA, 2169 bp, Homo sapiens
gaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggtgagaatacccagaggccagcagccgaggccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccat

SEQ ID NO: 240 - DNA, 2288 bp, Homo sapiens
gaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccat

SEQ ID NO: 241 - DNA, 1973 bp, Homo sapiens
acaaagaaagtcatttaagcccctttacagaccagctctgctgggaggatgcagaaataaatgatcagcgtcccggcgtgagagagctgcccccagaagtggccgggggagaaaagggtgaagaggagctaaagcttaggaggcgatttccacggaaatggatgctccctaaggatgtgcggaaaggggatgggaatgtgcggattgggggcgggggcaccaacgcactccggcgggcaagcggtctcccgcaccacctgctgcaaggctcgggaaggaaggcgaagatagcaccggggcatccccgggagtccgcaaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccat

SEQ ID NO: 242 - DNA, 1681 bp, Homo sapiens
ctgaacccgactgcgtctgtctcgcaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccat

SEQ ID NO: 243 - DNA, 2322 bp, Homo sapiens
gaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggtgagaatacccagaggccagcagccgaggccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccat

SEQ ID NO: 244 - DNA, 1353 bp, Homo sapiens
gaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaata

SEQ ID NO: 245 - DNA, 1506 bp, Homo sapiens
gaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaata

SEQ ID NO: 246 - DNA, 1357 bp, Homo sapiens
gaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacagggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaata

SEQ ID NO: 247 - DNA, 319 bp, Homo sapiens
acaaagaaagtcatttaagcccctttacagaccagctctgctgggaggatgcagaaataaatgatcagcgtcccggcgtgagagagctgcccccagaagtggccgggggagaaaagggtgaagaggagctaaagcttaggaggcgatttccacggaaatggatgctccctaaggatgtgcggaaaggggatgggaatgtgcggattgggggcgggggcaccaacgcactccggcgggcaagcggtctcccgcaccacctgctgcaaggctcgggaaggaaggcgaagatagcaccggggcatccccgggagtccgcaag

SEQ ID NO: 248 - DNA, 305 bp, Homo sapiens
gaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgt

SEQ ID NO: 249 - DNA, 153 bp, Homo sapiens
acactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctccca

SEQ ID NO: 250 - DNA, 734 bp, Homo sapiens
ggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaata

SEQ ID NO: 251 - DNA, 174 bp, Homo sapiens
gtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactg

SEQ ID NO: 252 - DNA, 487 bp, Homo sapiens
gtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgc

SEQ ID NO: 253 - DNA, 329 bp, Homo sapiens
ttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccag

SEQ ID NO: 254 - DNA, 315 bp, Homo sapiens
ggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccat

SEQ ID NO: 255 - DNA, 10 bp, Homo sapiens
ctccgcggca

SEQ ID NO: 256 - DNA, 52 bp, Homo sapiens
gcagcgcgggccccagcagcctcggcagccacagccgctgcagccggggcag

SEQ ID NO: 257 - DNA, 43 bp, Homo sapiens
cctccgctgctgtcgcctcctctgatgcgcttgccctctcccg

SEQ ID NO: 258 - DNA, 32 bp, Homo sapiens
gccccgggactccgggagaatgtgggtcctag

SEQ ID NO: 259 - DNA, 39 bp, Homo sapiens
gcatcgcggcaactttttgcggattgttcttgcttccag

SEQ ID NO: 260 - DNA, 34 bp, Homo sapiens
gtgagaatacccagaggccagcagccgaggccag

SEQ ID NO: 261 - DNA, 27 bp, Homo sapiens
ctgaacccgactgcgtctgtctcgcag

SEQ ID NO: 262 - DNA, 44 bp, Homo sapiens
gctttgcgctgcaaatccagtgctaccagtgtgaagaattccag

SEQ ID NO: 263 - DNA, 94 bp, Homo sapiens
ctgaacaacgactgctcctcccccgagttcattgtgaattgcacggtgaacgttcaagacatgtgtcagaaagaagtgatggagcaaagtgccg

SEQ ID NO: 264 - DNA, 4 bp, Homo sapiens
acag

SEQ ID NO: 265 - DNA, 58 bp, Homo sapiens
ggatcatgtaccgcaagtcctgtgcatcatcagcggcctgtctcatcgcctctgccgg

SEQ ID NO: 266 - DNA, 11 bp, Homo sapiens
ctgaagctgaa

SEQ ID NO: 267 - DNA, 63 bp, Homo sapiens
ggagatgccaccccctcctgcattgttcttccagccctcgcccccaaccccccacctccctga

SEQ ID NO: 268 - DNA, 30 bp, Homo sapiens
tctgaaaagtgcttaagaaaatcttctcag

SEQ ID NO: 269 - DNA, 49 bp, Homo sapiens
catacggccaatgtcacaacaatcagccctgggcagacacgagcaggag

SEQ ID NO: 270 - protein, 165 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLASSRHTAELKEMPPPPALFFQPSPPTPHLPE

SEQ ID NO: 271 - protein, 164 aa, Homo sapiens [sequence omitted]

SEQ ID NO: 272 - protein, 112 aa, Homo sapiens
MYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 273 - protein, 157 aa, Homo sapiens
MQAPRAAPAAPLSYDRRLRGSIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 274 - protein, 165 aa, Homo sapiens; identical to SEQ ID NO: 270

SEQ ID NO: 275 - protein, 141 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 276 - protein, 222 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGSPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 277 - protein, 39 aa, Homo sapiens
MWVLGIAATFCGLFLLPGENTQRPAAEARLCAANPVLPV

SEQ ID NO: 278 - protein, 84 aa, Homo sapiens
MWVLGIAATFCGLFLLPGFALQIQCYQCEEFQLNNDCSSPEFIVNCTVNVQDMCQKEVMEQSADTKRTNTLLFEMRHFAKQLTT

SEQ ID NO: 279 - protein, 93 aa, Homo sapiens
MWVLGIAATFCGLFLLPGFALQIQCYQCEEFQLNNDCSSPEFIVNCTVNVQDMCQKEVMEQSAGSHCVTRLECSGTISAHCNLCLPGSNDHPT

SEQ ID NO: 280 - protein, 90 aa, Homo sapiens
MWVLGIAATFCGLFLLPGFALQIQCYQCEEFQLNNDCSSPEFIVNCTVNVQDMCQKEVMEQSADRVSLCHEAGVQWNNFSTLQPLPPRLK

SEQ ID NO: 281 - protein, 112 aa, Homo sapiens; identical to SEQ ID NO: 272

SEQ ID NO: 282 - DNA, 3305 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaagctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttta

SEQ ID NO: 283 - DNA, 3368 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacactctgcccagccctgcccccacacgtgccctccttcttgtctcctgcgcagacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttta

SEQ ID NO: 284 - DNA, 3203 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcatgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttta

SEQ ID NO: 285 - DNA, 3486 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggtggctgctattgccagagcccactgagtagacgcggattacccgtttgtcagccccgggcatctgcgctgttccagagttttctagtccaatgacccgtggggagcgtctcgaatgacgctgccctcgaagcagcccggctctcagccccgtcctgccctctccccaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttta

SEQ ID NO: 286 - DNA, 3309 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttta

SEQ ID NO: 287 - DNA, 3277 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttta

SEQ ID NO: 288 - DNA, 3376 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggtggctgctattgccagagcccactgagtagacgcggattacccgtttgtcagccccgggcatctgcgctgttccagagttttctagtccaatgacccgtggggagcgtctcgaatgacgctgccctcgaagcagcccggctctcagccccgtcctgccctctccccaggcactggcgcgctgatcctgcaaaaggggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttta

SEQ ID NO: 289 - DNA, 3180 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttta

SEQ ID NO: 290 - DNA, 2636 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcggtggacttcagtgtgtgtatttgtgtaaatgagtaaaacattttatttcttttta

SEQ ID NO: 291 - DNA, 1442 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttta

SEQ ID NO: 292 - DNA, 2159 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgagctgtggccttcagcattcaaaggcgcttctccctgctccatgctgccccctcccctgtgatgtcccaaatgatgtcaagtcaggcagatgacacccaaatcaaagtgaagctgaccagccagcctccggaggccctcgct

SEQ ID NO: 293 - DNA, 1525 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccaggtggcccccggggcaggagggcggcaggtgggccccgggagaggcgggactggggactcacggcagggcttgtctccgcccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttta

SEQ ID NO: 294 - DNA, 291 bp, Homo sapiens
ccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgag

SEQ ID NO: 295 - DNA, 241 bp, Homo sapiens
acagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgca

SEQ ID NO: 296 - DNA, 131 bp, Homo sapiens
atactgcggagagaggtcccagttcgtcgtcaccagcaacagcaacaagatcacagttcgcttccactcagatcagtcctacaccgacaccggcttcttagctgaatacctctcctacgactccagtgacc

SEQ ID NO: 297 - DNA, 123 bp, Homo sapiens
tgaacgtcgtcacttgtaccaaacacacctaccgctgcctcaatgggctctgcttgagcaagggcaaccctgagtgtgacgggaaggaggactgtagcgacggctcagatgagaaggactgcg

SEQ ID NO: 298 - DNA, 142 bp, Homo sapiens
agctgtggccttcagcattcaaaggcgcttctccctgctccatgctgccccctcccctgtgatgtcccaaatgatgtcaagtcaggcagatgacacccaaatcaaagtgaagctgaccagccagcctccggaggccctcgct

SEQ ID NO: 299 - DNA, 162 bp, Homo sapiens
acaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcag

SEQ ID NO: 300 - DNA, 256 bp, Homo sapiens
tggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggag

SEQ ID NO: 301 - DNA, 169 bp, Homo sapiens
gtggctgctattgccagagcccactgagtagacgcggattacccgtttgtcagccccgggcatctgcgctgttccagagttttctagtccaatgacccgtggggagcgtctcgaatgacgctgccctcgaagcagcccggctctcagccccgtcctgccctctccccag

SEQ ID NO: 302 - DNA, 377 bp, Homo sapiens
tctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacg

SEQ ID NO: 303 - DNA, 50 bp, Homo sapiens
aaagtgaatggcttggaggaaggcgtggagttcctgccagtcaacaacgt

SEQ ID NO: 304 - DNA, 7 bp, Homo sapiens
caagaag

SEQ ID NO: 305 - DNA, 103 bp, Homo sapiens
gtggaaaagcatggcccggggcgctgggtggtgctggcagccgtgctgatcggcctcctcttggtcttgctggggatcggcttcctggtgtggcatttgcagt

SEQ ID NO: 306 - DNA, 116 bp, Homo sapiens
accgggacgtgcgtgtccagaaggtcttcaatggctacatgaggatcacaaatgagaattttgtggatgcctacgagaactccaactccactgagtttgtaagcctggccagcaag

SEQ ID NO: 307 - DNA, 12 bp, Homo sapiens
gtgaaggacgcg

SEQ ID NO: 308 - DNA, 30 bp, Homo sapiens
ctgaagctgctgtacagcggagtcccattc

SEQ ID NO: 309 - DNA, 41 bp, Homo sapiens
ctgggcccctaccacaaggagtcggctgtgacggccttcag

SEQ ID NO: 310 - DNA, 55 bp, Homo sapiens
cgagggcagcgtcatcgcctactactggtctgagttcagcatcccgcagcacctg

SEQ ID NO: 311 - DNA, 103 bp, Homo sapiens
gtggaggaggccgagcgcgtcatggccgaggagcgcgtagtcatgctgcccccgcgggcgcgctccctgaagtcctttgtggtcacctcagtggtggctttcc

SEQ ID NO: 312 - DNA, 36 bp, Homo sapiens
ccacggactccaaaacagtacagaggacccaggaca

SEQ ID NO: 313 - DNA, 51 bp, Homo sapiens
ctctgcccagccctgcccccacacgtgccctccttcttgtctcctgcgcag

SEQ ID NO: 314 - DNA, 58 bp, Homo sapiens
gttgtgtggcacctaccctccctcctacaacctgaccttccactcctcccagaacgtc

SEQ ID NO: 315 - DNA, 8 bp, Homo sapiens
ctgctcat

SEQ ID NO: 316 - DNA, 74 bp, Homo sapiens
cacactgataaccaacactgagcggcggcatcccggctttgaggccaccttcttccagctgcctaggatgagca

SEQ ID NO: 317 - DNA, 98 bp, Homo sapiens
gctgtggaggccgcttacgtaaagcccaggggacattcaacagcccctactacccaggccactacccacccaacattgactgcacatggaacattgag

SEQ ID NO: 318 - DNA, 110 bp, Homo sapiens
gtgcccaacaaccagcatgtgaaggtgcgcttcaaattcttctacctgctggagcccggcgtgcctgcgggcacctgccccaaggactacgtggagatcaatggggagaa

SEQ ID NO: 319 - DNA, 105 bp, Homo sapiens
catgcccggggcagttcacgtgccgcacggggcggtgtatccggaaggagctgcgctgtgatggctgggccgactgcaccgaccacagcgatgagctcaactgca

SEQ ID NO: 320 - DNA, 25 bp, Homo sapiens
gttgcgacgccggccaccagttcac

SEQ ID NO: 321 - DNA, 86 bp, Homo sapiens
gtgcaagaacaagttctgcaagcccctcttctgggtctgcgacagtgtgaacgactgcggagacaacagcgacgagcaggggtgca

SEQ ID NO: 322 - DNA, 114 bp, Homo sapiens
gttgtccggcccagaccttcaggtgttccaatgggaagtgcctctcgaaaagccagcagtgcaatgggaaggacgactgtggggacgggtccgacgaggcctcctgccccaagg

SEQ ID NO: 323 - DNA, 25 bp, Homo sapiens
actgtgggctgcggtcattcacgag

SEQ ID NO: 324 - DNA, 8 bp, Homo sapiens
gtactcag

SEQ ID NO: 325 - DNA, 11 bp, Homo sapiens
accccacgcag

SEQ ID NO: 326 - DNA, 27 bp, Homo sapiens
gcactggcgcgctgatcctgcaaaagg

SEQ ID NO: 327 - DNA, 44 bp, Homo sapiens
gtgagatccgcgtcatcaaccagaccacctgcgagaacctcctg

SEQ ID NO: 328 - DNA, 26 bp, Homo sapiens
ccgcagcagatcacgccgcgcatgat

SEQ ID NO: 329 - DNA, 4 bp, Homo sapiens
gtgc

SEQ ID NO: 330 - DNA, 14 bp, Homo sapiens
gtgggcttcctcag

SEQ ID NO: 331 - DNA, 22 bp, Homo sapiens
cggcggcgtggactcctgccag

SEQ ID NO: 332 - DNA, 83 bp, Homo sapiens
gtggcccccggggcaggagggcggcaggtgggccccgggagaggcgggactggggactcacggcagggcttgtctccgcccag

SEQ ID NO: 333 - DNA, 58 bp, Homo sapiens
ggtgattccgggggacccctgtccagcgtggaggcggatgggcggatcttccaggccg

SEQ ID NO: 334 - DNA, 64 bp, Homo sapiens
gtgtggtgagctggggagacggctgcgctcagaggaacaagccaggcgtgtacacaaggctccc

SEQ ID NO: 335 - DNA, 40 bp, Homo sapiens
gagcttcggagcctcctcagtgaaggtggtggggctgccg

SEQ ID NO: 336 - DNA, 106 bp, Homo sapiens
gatctgggctgtggggcccttgggccacgctcttgaggaagcccaggctcggaggaccctggaaaacagacgggtctgagactgaaattgttttaccagctcccag

SEQ ID NO: 337 - DNA, 56 bp, Homo sapiens
ggtggacttcagtgtgtgtatttgtgtaaatgagtaaaacattttatttcttttta

SEQ ID NO: 338 - protein, 855 aa, Homo sapiens [sequence omitted]

SEQ ID NO: 339 - protein, 851 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKLKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 340 - protein, 872 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDTLPSPAPTRALLLVSCADSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 341 - protein, 817 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCMNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 342 - protein, 787 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGGCYCQSPLSRRGLPVCQPRASALFQSFLVQ

SEQ ID NO: 343 - protein, 701 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRPHAVDGLPGLARPEPAQRPWGAGAQAQAHHLPPLLQ

SEQ ID NO: 344 - protein, 810 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMVIPGDPCPAWRRMGGSSRPVW

SEQ ID NO: 345 - protein, 757 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGG

SEQ ID NO: 346 - protein, 230 aa, Homo sapiens
MGSDRARKGGGGPKDFGAGLKYNSRHEKVNGLEEGVEFLPVNNVKKWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 347 - protein, 622 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCELWPSAFKGASPCSMLPPPL

SEQ ID NO: 348 - protein, 226 aa, Homo sapiens
MGSDRARKGGGGPKDFGAGLKYNSRHEKVNGLEEGVEFLPVNNVKKWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQVAPGAGGRQVGPGRGGTGDSRQGLSPPRVIPGDPCPAWRRMGGSSRPVW

SEQ ID NO: 349 - protein, 800 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCGGLQCVYLCK

SEQ ID NO: 350 - DNA, 5390 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtgggtatgggctggggagggttatgctgcacaggaagtggtgggcccagacgtttgtcaccttgtactcagcccctgtgtacagaacatggcacagaagccatttttgtggcagcggtggggattcggccgtctcaccatgctgctgcacagtcttagagtccttgctcagagccgggctgtcgtttatttaacatccaacggtcggtgtgtgtgtgtgtgtgttgtgggggagtgggggggtgttctcttcctacaatgctgcctcccaggttcctgcagcagccacacatatctctgggtggctggggaggaggaccaggtcagaatgcagtaggacaaggttcttttctccaggaggcccagagaggatgatgggtcaggtaaaaggccctgcacttaactctctgcccctgggagacttatttctcctctggggacttgtttctgcatccacaggtgaaagtggtttaaatgagaagctcttaaactttcttggtttggcagcagagttatttttctagacaaagtataatgtgaaagtttaaatggatgaaaatgaactgaggaggcccccttggtgggagccactggggtgtgtgtggcagttgggggatcctgcatggtctcccttcattcccctaatgcctcttgaggcccctcagtgtgggccattaaaaggcccctagaccagcagatcccttctacagatctgcttattgaaaaacctgctctgtgccaggcagtgcctggaattctaaacctgaagctcccaaatgctgctctccggggcctggctcacattatcaagtcacttgggaagcttaacaaataacgtgggtttgtggtagctccttgacaggtgtgcttatccgtgtcgcctgtcttggcttccgatgcaaagccagcttgggaacccctggcctcatctccttcagagtcttcgtttgaccttggtggggcatgaggacctgctggcccttgttaaagccagtgaaggtggtgaccctcccgggccatctgttaagttgccctgttgatggggttgggaggagttagtagagaagcagggcttcttttgcttagcagcccctgcccagacccatctgtgtgtctctcagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgt

SEQ ID NO: 351 - DNA, 4363 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctggtgagcctggggtgggggcggaagggatgaggtgagcacaggagggcctcaccacccaggctgcatgctcccccatctttccctctccagatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgt

SEQ ID NO: 352 - DNA, 4082 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgt

SEQ ID NO: 353 - DNA, 5374 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccagaatggctccctggtgatccatgacgtggcccctgaggactcaggccgctacacctgcattgcaggcaacagctgcaacatcaagcacacggaggcccccctctatgtcgtgggtatgggctggggagggttatgctgcacaggaagtggtgggcccagacgtttgtcaccttgtactcagcccctgtgtacagaacatggcacagaagccatttttgtggcagcggtggggattcggccgtctcaccatgctgctgcacagtcttagagtccttgctcagagccgggctgtcgtttatttaacatccaacggtcggtgtgtgtgtgtgtgtgttgtgggggagtgggggggtgttctcttcctacaatgctgcctcccaggttcctgcagcagccacacatatctctgggtggctggggaggaggaccaggtcagaatgcagtaggacaaggttcttttctccaggaggcccagagaggatgatgggtcaggtaaaaggccctgcacttaactctctgcccctgggagacttatttctcctctggggacttgtttctgcatccacaggtgaaagtggtttaaatgagaagctcttaaactttcttggtttggcagcagagttatttttctagacaaagtataatgtgaaagtttaaatggatgaaaatgaactgaggaggcccccttggtgggagccactggggtgtgtgtggcagttgggggatcctgcatggtctcccttcattcccctaatgcctcttgaggcccctcagtgtgggccattaaaaggcccctagaccagcagatcccttctacagatctgcttattgaaaaacctgctctgtgccaggcagtgcctggaattctaaacctgaagctcccaaatgctgctctccggggcctggctcacattatcaagtcacttgggaagcttaacaaataacgtgggtttgtggtagctccttgacaggtgtgcttatccgtgtcgcctgtcttggcttccgatgcaaagccagcttgggaacccctggcctcatctccttcagagtcttcgtttgaccttggtggggcatgaggacctgctggcccttgttaaagccagtgaaggtggtgaccctcccgggccatctgttaagttgccctgttgatggggttgggaggagttagtagagaagcagggcttcttttgcttagcagcccctgcccagacccatctgtgtgtctctcagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgt

SEQ ID NO: 354 - DNA, 5392 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtgggtatgggctggggagggttatgctgcacaggaagtggtgggcccagacgtttgtcaccttgtactcagcccctgtgtacagaacatggcacagaagccatttttgtggcagcggtggggattcggccgtctcaccatgctgctgcacagtcttagagtccttgctcagagccgggctgtcgtttatttaacatccaacggtcggtgtgtgtgtgtgtgtgttgtgggggagtgggggggtgttctcttcctacaatgctgcctcccaggttcctgcagcagccacacatatctctgggtggctggggaggaggaccaggtcagaatgcagtaggacaaggttcttttctccaggaggcccagagaggatgatgggtcaggtaaaaggccctgcacttaactctctgcccctgggagacttatttctcctctggggacttgtttctgcatccacaggtgaaagtggtttaaatgagaagctcttaaactttcttggtttggcagcagagttatttttctagacaaagtataatgtgaaagtttaaatggatgaaaatgaactgaggaggcccccttggtgggagccactggggtgtgtgtggcagttgggggatcctgcatggtctcccttcattcccctaatgcctcttgaggcccctcagtgtgggccattaaaaggcccctagaccagcagatcccttctacagatctgcttattgaaaaacctgctctgtgccaggcagtgcctggaattctaaacctgaagctcccaaatgctgctctccggggcctggctcacattatcaagtcacttgggaagcttaacaaataacgtgggtttgtggtagctccttgacaggtgtgcttatccgtgtcgcctgtcttggcttccgatgcaaagccagcttgggaacccctggcctcatctccttcagagtcttcgtttgaccttggtggggcatgaggacctgctggcccttgttaaagccagtgaaggtggtgaccctcccgggccatctgttaagttgccctgttgatggggttgggaggagttagtagagaagcagggcttcttttgcttagcagcccctgcccagacccatctgtgtgtctctcagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggagggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgt

SEQ ID NO: 355 - DNA, 6220 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtgggtatgggctggggagggttatgctgcacaggaagtggtgggcccagacgtttgtcaccttgtactcagcccctgtgtacagaacatggcacagaagccatttttgtggcagcggtggggattcggccgtctcaccatgctgctgcacagtcttagagtccttgctcagagccgggctgtcgtttatttaacatccaacggtcggtgtgtgtgtgtgtgtgttgtgggggagtgggggggtgttctcttcctacaatgctgcctcccaggttcctgcagcagccacacatatctctgggtggctggggaggaggaccaggtcagaatgcagtaggacaaggttcttttctccaggaggcccagagaggatgatgggtcaggtaaaaggccctgcacttaactctctgcccctgggagacttatttctcctctggggacttgtttctgcatccacaggtgaaagtggtttaaatgagaagctcttaaactttcttggtttggcagcagagttatttttctagacaaagtataatgtgaaagtttaaatggatgaaaatgaactgaggaggcccccttggtgggagccactggggtgtgtgtggcagttgggggatcctgcatggtctcccttcattcccctaatgcctcttgaggcccctcagtgtgggccattaaaaggcccctagaccagcagatcccttctacagatctgcttattgaaaaacctgctctgtgccaggcagtgcctggaattctaaacctgaagctcccaaatgctgctctccggggcctggctcacattatcaagtcacttgggaagcttaacaaataacgtgggtttgtggtagctccttgacaggtgtgcttatccgtgtcgcctgtcttggcttccgatgcaaagccagcttgggaacccctggcctcatctccttcagagtcttcgtttgaccttggtggggcatgaggacctgctggcccttgttaaagccagtgaaggtggtgaccctcccgggccatctgttaagttgccctgttgatggggttgggaggagttagtagagaagcagggcttcttttgcttagcagcccctgcccagacccatctgtgtgtctctcagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgaggggccctggacggggaggtggtgcccgtgtgcgggagctgagcgccctcccgcggccacggaggggagagcgccagcactctggaaaccgagcggctgttgctgggtcctggagctgggactgccccacccctagcgggaagcctggagttggattcccagggcctcgtcttctgagcaacctggcttgagacttcttcattggagccccttggaccagcttcctatgattccctgctgtttcctcctcccagcacaaaaccacagatatcattagtatatgtacacacgttgctgttgcatgtcttgtctccctctatgagtctaagagctcccccaggggcagtctttctgtttacttcccttctcctatccccacttcctggactgggagctccttgaggtcattgctgggtctctcctatcagctcaggtgttcaggagcagaggttgggtctccattattgtgattttccctttgtgcctgtttagggctttgcccaataggaggccccatgaaagcaaaaatccttatgtgtagctatggtattaaggaccagtgattcagattagatgtctgcagttggcttcatctcagaggtcataatcagctgcatcactaaggggtcataccctaggggatagccatacatcccccacccagccccagccccattatttcatcatttgggcttgccctttcatgtggagcactgtgattggacccaagttggcaagagtggaagaccaggggacagaacagaaatccccatggtggccagagtgtcaggtctcatcgtgacgctcttgtcctcctccttcccaggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgt

SEQ ID NO: 356 - DNA, 4077 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgt

SEQ ID NO: 357 - DNA, 3883 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccaatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgt

SEQ ID NO: 358 - DNA, 5335 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtgggtatgggctggggagggttatgctgcacaggaagtggtgggcccagacgtttgtcaccttgtactcagcccctgtgtacagaacatggcacagaagccatttttgtggcagcggtggggattcggccgtctcaccatgctgctgcacagtcttagagtccttgctcagagccgggctgtcgtttatttaacatccaacggtcggtgtgtgtgtgtgtgtgttgtgggggagtgggggggtgttctcttcctacaatgctgcctcccaggttcctgcagcagccacacatatctctgggtggctggggaggaggaccaggtcagaatgcagtaggacaaggttcttttctccaggaggcccagagaggatgatgggtcaggtaaaaggccctgcacttaactctctgcccctgggagacttatttctcctctggggacttgtttctgcatccacaggtgaaagtggtttaaatgagaagctcttaaactttcttggtttggcagcagagttatttttctagacaaagtataatgtgaaagtttaaatggatgaaaatgaactgaggaggcccccttggtgggagccactggggtgtgtgtggcagttgggggatcctgcatggtctcccttcattcccctaatgcctcttgaggcccctcagtgtgggccattaaaaggcccctagaccagcagatcccttctacagatctgcttattgaaaaacctgctctgtgccaggcagtgcctggaattctaaacctgaagctcccaaatgctgctctccggggcctggctcacattatcaagtcacttgggaagcttaacaaataacgtgggtttgtggtagctccttgacaggtgtgcttatccgtgtcgcctgtcttggcttccgatgcaaagccagcttgggaacccctggcctcatctccttcagagtcttcgtttgaccttggtggggcatgaggacctgctggcccttgttaaagccagtgaaggtggtgaccctcccgggccatctgttaagttgccctgttgatggggttgggaggagttagtagagaagcagggcttcttttgcttagcagcccctgcccagacccatctgtgtgtctctcagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctgggtatgttgccttgactacagctgcccctgcctaactacaagtcacccgctgtgtcttgaggctgggtacgggctagtgttctgaagtccctgaaacctagaatgttagaggtggagggaagcataggtagagatctagcccagtgtggccccagagcctgttattcactgcccttcgtgcagattttgtcattcctgtgtactacctgtagtattatttacttgatgttttatttaaattgactctttaaaaaaaaaaactaagttaccattgttctaggaaaaaatatgagaaatcatgggtttgtcatagttacgttttttcctagcatacgttaagacatgtttaccatgagccaccaaaaattctcatgcgagtcaccctttggaaaatgctgaatattagtcccacccttttattttgttgctgcagacactgaagcctaaggagggagggggtcacagcagaaccgggtctcgtgcccagcccaggtgggtgggtccccactgtgggagaggctaggcccctcccccaggtcaggagctgcctcggcctgggtgaaggtggctggctgactcagactgtacccacagggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctggtatgctgttggcaggggacgtgggggtctcgggtagggagggcagtgtcctacaaaggtgggagtcagtggttggagcaccgtgaaaaccttgtctcgtgcagtctcagccgagacctcacctgcctgctgttacactttgcccaccttatgatgctcagcttctgccttccctgctcttggatgcctgctttccctttatcagcacccagtctttccatctgtatctcaggggcgttggtcctaagtttttctgggacttctcactgtcacactgcagggatgccttccaggtcatcttctctgactcttgttttctttggtttgttattttttcctccccaaaagcttgtccccacttgagaataaatatatcagaacccactttgcctccctccttcctagcaccacttgtgacatgagtgttaccccagccaccagccttctcctctccactcagggtgtcattcccagagctgcgccttcctcttcattccccagctggtccttgccctcaccccatggtcctcaaactgctgcttctcaaatccctagttctggggcaagagcgggcaggagtcctatcagtctttccattaacaagtacttacgcggctgggcacagtggctcacacttgtaatcccagcactttgggagactgaggcaggaggatcgcctgaggccaggagtccgagaccagcctgggcaacatagcaagactctgtctctacaaaaaaattaaaaacaaacaaacaagtactta

SEQ ID NO: 359 - DNA, 2482 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccagtgagcacctttgccctgaaggtcaaggagaggtggaggggaacacaggtctgggtgtgatggacagaggcttccctggtactcacctgaggtcctctcagttctgggccctgcaggcttgggaatcagttcactactgggagtcggtgtagacagtagagagccaggcacaggggttagggtgggtgctccagaggaaatagtgacagccctcacagaaaaatggtcctctgggtacagaggaaagagcaatagactaggaatctagagacctgggtcccactatgctcccaatgcacagagtgacgatggtagcaaatcacccaccttactggggttcagtctcctcatccataaaatggagccagtaatctactacctaccccacaaggtggttggaaaggtcaaatgaagtagatgaaaatgatttttctttttttcttttttgggaggtaatagtggacaaaattataggtgatttttaatttgttttagtttgttatgctttccaaatttctttactaaacatattacttatgaaaaaaaagagggggagaaaagcaagacatatgactgaaagtacacatgataaaccctttatatcaggctgggcgcggtggctcatgcctgtaatcccagcactttgggaggccgagccgggcggatcacaaggtcaggagttggagaccagcctgaccaacatggtgaaaccccatctctactaaaaatacaaaaattagctgggcgtggtggggcacacctgtaatcccagctactcaggaggctgagggaggaaaattgcttgaacccaggaggcagaggttgcaatgagctgagatcgcaccgttgctcttcagcccgggcaacagagtgagactccatctcaaaacaaaacaaaacaaaccttatatcctcactacaggcatagggatttatttgtttacttatttctttataccatgccttgttccaaaccttttgtggtagtttaaaaggatacacaataaaaattacaatatgcacacagagacac

SEQ ID NO: 360 - DNA, 2800 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccagtgagcacctttgccctgaaggtcaaggagaggtggaggggaacacaggtctgggtgtgatggacagaggcttccctggtactcacctgaggtcctctcagttctgggccctgcaggcttgggaatcagttcactactgggagtcggtgtagacagtagagagccaggcacaggggttagggtgggtgctccagaggaaatagtgacagccctcacagaaaaatggtcctctgggtacagaggaaagagcaatagactaggaatctagagacctgggtcccactatgctcccaatgcacagagtgacgatggtagcaaatcacccaccttactggggttcagtctcctcatccataaaatggagccagtaatctactacctaccccacaaggtggttggaaaggtcaaatgaagtagatgaaaatgatttttctttttttcttttttgggaggtaatagtggacaaaattataggtgatttttaatttgttttagtttgttatgctttccaaatttctttactaaacatattacttatgaaaaaaaagagggggagaaaagcaagacatatgactgaaagtacacatgataaaccctttatatcaggctgggcgcggtggctcatgcctgtaatcccagcactttgggaggccgagccgggcggatcacaaggtcaggagttggagaccagcctgaccaacatggtgaaaccccatctctactaaaaatacaaaaattagctgggcgtggtggggcacacctgtaatcccagctactcaggaggctgagggaggaaaattgcttgaacccaggaggcagaggttgcaatgagctgagatcgcaccgttgctcttcagcccgggcaacagagtgagactccatctcaaaacaaaacaaaacaaaccttatatcctcactacaggcatagggatttatttgtttacttatttctttataccatgccttgttccaaaccttttgtggtagtttaaaaggatacacaataaaaattacaatatgcacacagagacacacatacatacaaactattttgcaatctgcttcttccacttacctttatgttactattatctttccgagtgggtaactttgcaaaaagatttgaatatgaaagtggctttgtaaatgtgaagttgtgatgctagtattcccattaggatactgaaatcttagaagacatgcacctatactcaggccgtgatttgggtgggaatcacagcacatgtgtaacgagtgctcaggacactcacagtgcaggtgcaaaggcaagatgcacagtcaagccttcctccagttgaggtctgagaatcacctgctttcattagggata

SEQ ID NO: 361 - DNA, 985 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatgtgagagccaggggggctgtgcccagtccccctgtcagaccctcaatgactgaggcctgggggatccctcccttacctcagcttctcccatttccagttaaacgggccaggcagaatgcatttatcatcagctttttttgctcatgtggataagaggaaattaaaagttatattttttccaaaattttttccttcaagtctgggacccatttatctgctgcatgcttgtgcaaatggaaagggcggccgagcccttggccaagtgtcagacttgacctgccagggaccaggcaggcacttagtatctggtaactgtagccccagcctcagcctccagggcttccttgtgtctgttggcacagagcctcgaggttccacggcttcctgcttgtcctcc

SEQ ID NO: 362 - DNA, 300 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcg

SEQ ID NO: 363 - DNA, 288 bp, Homo sapiens
gtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaat

SEQ ID NO: 364 - DNA, 397 bp, Homo sapiens
gtgagagccaggggggctgtgcccagtccccctgtcagaccctcaatgactgaggcctgggggatccctcccttacctcagcttctcccatttccagttaaacgggccaggcagaatgcatttatcatcagctttttttgctcatgtggataagaggaaattaaaagttatattttttccaaaattttttccttcaagtctgggacccatttatctgctgcatgcttgtgcaaatggaaagggcggccgagcccttggccaagtgtcagacttgacctgccagggaccaggcaggcacttagtatctggtaactgtagccccagcctcagcctccagggcttccttgtgtctgttggcacagagcctcgaggttccacggcttcctgcttgtcctcc

SEQ ID NO: 365 - DNA, 191 bp, Homo sapiens
gcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctg

SEQ ID NO: 366 - DNA, 151 bp, Homo sapiens
atgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcg

SEQ ID NO: 367 - DNA, 149 bp, Homo sapiens
ccccccacacctccgcagagccacagtgtttgccaacgggtctctgctgctgacccaggtccggccacgcaatgcagggatctaccgctgcattggccaggggcagaggggcccacccatcatcctggaagccacacttcacctagcag

SEQ ID NO: 368 - DNA, 199 bp, Homo sapiens
cttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggcca

SEQ ID NO: 369 - DNA, 1351 bp, Homo sapiens
gtgagcacctttgccctgaaggtcaaggagaggtggaggggaacacaggtctgggtgtgatggacagaggcttccctggtactcacctgaggtcctctcagttctgggccctgcaggcttgggaatcagttcactactgggagtcggtgtagacagtagagagccaggcacaggggttagggtgggtgctccagaggaaatagtgacagccctcacagaaaaatggtcctctgggtacagaggaaagagcaatagactaggaatctagagacctgggtcccactatgctcccaatgcacagagtgacgatggtagcaaatcacccaccttactggggttcagtctcctcatccataaaatggagccagtaatctactacctaccccacaaggtggttggaaaggtcaaatgaagtagatgaaaatgatttttctttttttcttttttgggaggtaatagtggacaaaattataggtgatttttaatttgttttagtttgttatgctttccaaatttctttactaaacatattacttatgaaaaaaaagagggggagaaaagcaagacatatgactgaaagtacacatgataaaccctttatatcaggctgggcgcggtggctcatgcctgtaatcccagcactttgggaggccgagccgggcggatcacaaggtcaggagttggagaccagcctgaccaacatggtgaaaccccatctctactaaaaatacaaaaattagctgggcgtggtggggcacacctgtaatcccagctactcaggaggctgagggaggaaaattgcttgaacccaggaggcagaggttgcaatgagctgagatcgcaccgttgctcttcagcccgggcaacagagtgagactccatctcaaaacaaaacaaaacaaaccttatatcctcactacaggcatagggatttatttgtttacttatttctttataccatgccttgttccaaaccttttgtggtagtttaaaaggatacacaataaaaattacaatatgcacacagagacacacatacatacaaactattttgcaatctgcttcttccacttacctttatgttactattatctttccgagtgggtaactttgcaaaaagatttgaatatgaaagtggctttgtaaatgtgaagttgtgatgctagtattcccattaggatactgaaatcttagaagacatgcacctatactcaggccgtgatttgggtgggaatcacagcacatgtgtaacgagtgctcaggacactcacagtgcaggtgcaaaggcaagatgcacagtcaagccttcctccagttgaggtctgagaatcacctgctttcattagggata

SEQ ID NO: 370 - DNA, 134 bp, Homo sapiens
ctgtgccctcctggctgaagaagccccaagacagccagctggaggagggcaaacccggctacttggattgcctgacccaggccacaccaaaacctacagttgtctggtacagaaaccagatgctcatctcagag

SEQ ID NO: 371 - DNA, 121 bp, Homo sapiens
gtcttcaagaatgggaccttgcgcatcaacagcgtggaggtgtatgatgggacatggtaccgttgtatgagcagcaccccagccggcagcatcgaggcgcaagcccgtgtccaagtgctgg

SEQ ID NO: 372 - DNA, 120 bp, Homo sapiens
aaaagctcaagttcacaccaccaccccagccacagcagtgcatggagtttgacaaggaggccacggtgccctgttcagccacaggccgagagaagcccactattaagtgggaacgggcag

SEQ ID NO: 373 - DNA, 150 bp, Homo sapiens
atgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcag

SEQ ID NO: 374 - DNA, 1117 bp, Homo sapiens
gtatgggctggggagggttatgctgcacaggaagtggtgggcccagacgtttgtcaccttgtactcagcccctgtgtacagaacatggcacagaagccatttttgtggcagcggtggggattcggccgtctcaccatgctgctgcacagtcttagagtccttgctcagagccgggctgtcgtttatttaacatccaacggtcggtgtgtgtgtgtgtgtgttgtgggggagtgggggggtgttctcttcctacaatgctgcctcccaggttcctgcagcagccacacatatctctgggtggctggggaggaggaccaggtcagaatgcagtaggacaaggttcttttctccaggaggcccagagaggatgatgggtcaggtaaaaggccctgcacttaactctctgcccctgggagacttatttctcctctggggacttgtttctgcatccacaggtgaaagtggtttaaatgagaagctcttaaactttcttggtttggcagcagagttatttttctagacaaagtataatgtgaaagtttaaatggatgaaaatgaactgaggaggcccccttggtgggagccactggggtgtgtgtggcagttgggggatcctgcatggtctcccttcattcccctaatgcctcttgaggcccctcagtgtgggccattaaaaggcccctagaccagcagatcccttctacagatctgcttattgaaaaacctgctctgtgccaggcagtgcctggaattctaaacctgaagctcccaaatgctgctctccggggcctggctcacattatcaagtcacttgggaagcttaacaaataacgtgggtttgtggtagctccttgacaggtgtgcttatccgtgtcgcctgtcttggcttccgatgcaaagccagcttgggaacccctggcctcatctccttcagagtcttcgtttgaccttggtggggcatgaggacctgctggcccttgttaaagccagtgaaggtggtgaccctcccgggccatctgttaagttgccctgttgatggggttgggaggagttagtagagaagcagggcttcttttgcttagcagcccctgcccagacccatctgtgtgtctctcag

SEQ ID NO: 375 - DNA, 830 bp, Homo sapiens
gtgaggggccctggacggggaggtggtgcccgtgtgcgggagctgagcgccctcccgcggccacggaggggagagcgccagcactctggaaaccgagcggctgttgctgggtcctggagctgggactgccccacccctagcgggaagcctggagttggattcccagggcctcgtcttctgagcaacctggcttgagacttcttcattggagccccttggaccagcttcctatgattccctgctgtttcctcctcccagcacaaaaccacagatatcattagtatatgtacacacgttgctgttgcatgtcttgtctccctctatgagtctaagagctcccccaggggcagtctttctgtttacttcccttctcctatccccacttcctggactgggagctccttgaggtcattgctgggtctctcctatcagctcaggtgttcaggagcagaggttgggtctccattattgtgattttccctttgtgcctgtttagggctttgcccaataggaggccccatgaaagcaaaaatccttatgtgtagctatggtattaaggaccagtgattcagattagatgtctgcagttggcttcatctcagaggtcataatcagctgcatcactaaggggtcataccctaggggatagccatacatcccccacccagccccagccccattatttcatcatttgggcttgccctttcatgtggagcactgtgattggacccaagttggcaagagtggaagaccaggggacagaacagaaatccccatggtggccagagtgtcaggtctcatcgtgacgctcttgtcctcctccttcccag

SEQ ID NO: 376 - DNA, 591 bp, Homo sapiens
gtatgttgccttgactacagctgcccctgcctaactacaagtcacccgctgtgtcttgaggctgggtacgggctagtgttctgaagtccctgaaacctagaatgttagaggtggagggaagcataggtagagatctagcccagtgtggccccagagcctgttattcactgcccttcgtgcagattttgtcattcctgtgtactacctgtagtattatttacttgatgttttatttaaattgactctttaaaaaaaaaaactaagttaccattgttctaggaaaaaatatgagaaatcatgggtttgtcatagttacgttttttcctagcatacgttaagacatgtttaccatgagccaccaaaaattctcatgcgagtcaccctttggaaaatgctgaatattagtcccacccttttattttgttgctgcagacactgaagcctaaggagggagggggtcacagcagaaccgggtctcgtgcccagcccaggtgggtgggtccccactgtgggagaggctaggcccctcccccaggtcaggagctgcctcggcctgggtgaaggtggctggctgactcagactgtacccac

SEQ ID NO: 377 - DNA, 213 bp, Homo sapiens
gtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctg

SEQ ID NO: 378 - DNA, 476 bp, Homo sapiens
gtatgctgttggcaggggacgtgggggtctcgggtagggagggcagtgtcctacaaaggtgggagtcagtggttggagcaccgtgaaaaccttgtctcgtgcagtctcagccgagacctcacctgcctgctgttacactttgcccaccttatgatgctcagcttctgccttccctgctcttggatgcctgctttccctttatcagcacccagtctttccatctgtatctcaggggcgttggtcctaagtttttctgggacttctcactgtcacactgcagggatgccttccaggtcatcttctctgactcttgttttctttggtttgttattttttcctccccaaaagcttgtccccacttgagaataaatatatcagaacccactttgcctccctccttcctagcaccacttgtgacatgagtgttaccccagccaccagccttctcctctccactcagggtgtcattcccagag

SEQ ID NO: 379 - DNA, 288 bp, Homo sapiens
ctgcgccttcctcttcattccccagctggtccttgccctcaccccatggtcctcaaactgctgcttctcaaatccctagttctggggcaagagcgggcaggagtcctatcagtctttccattaacaagtacttacgcggctgggcacagtggctcacacttgtaatcccagcactttgggagactgaggcaggaggatcgcctgaggccaggagtccgagaccagcctgggcaacatagcaagactctgtctctacaaaaaaattaaaaacaaacaaacaagtactta

SEQ ID NO: 380 - DNA, 152 bp, Homo sapiens
gtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacag

SEQ ID NO: 381 - DNA, 122 bp, Homo sapiens
tgagtactaccacttccgccaggcctgggtgccgctgcgctggatgtcccccgaggccatcctggagggtgacttctctaccaagtctgatgtctgggccttcggtgtgctgatgtgggaag

SEQ ID NO: 382 - DNA, 700 bp, Homo sapiens
atttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccac

SEQ ID NO: 383 - DNA, 254 bp, Homo sapiens
atgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgt

SEQ ID NO: 384 - DNA, 103 bp, Homo sapiens
ggattgaggcaggtcctgtggtcctgaagcatccagcctcggaagctgagatccagccacagacccaggtcacacttcgttgccacattgatgggcaccctcg

SEQ ID NO: 385 - DNA, 90 bp, Homo sapiens
gtgagcctggggtgggggcggaagggatgaggtgagcacaggagggcctcaccacccaggctgcatgctcccccatctttccctctccag

SEQ ID NO: 386 - DNA, 68 bp, Homo sapiens
agattgaagacatgccgctatttgagccacgggtgtttacagctggcagcgaggagcgtgtgacctgc

SEQ ID NO: 387 - DNA, 15 bp, Homo sapiens
gactcacggttcgag

SEQ ID NO: 388 - DNA, 111 bp, Homo sapiens
tttttatcaccttcaaagtggaaccagagcgtacgactgtgtaccagggccacacagccctactgcagtgcgaggcccagggggaccccaagccgctgattcagtggaaag

SEQ ID NO: 389 - DNA, 40 bp, Homo sapiens
gcaaggaccgcatcctggaccccaccaagctgggacccag

SEQ ID NO: 390 - DNA, 16 bp, Homo sapiens
gatgcacatcttccag

SEQ ID NO: 391 - DNA, 112 bp, Homo sapiens
aatggctccctggtgatccatgacgtggcccctgaggactcaggccgctacacctgcattgcaggcaacagctgcaacatcaagcacacggaggcccccctctatgtcgtgg

SEQ ID NO: 392 - DNA, 5 bp, Homo sapiens
acaag

SEQ ID NO: 393 - DNA, 119 bp, Homo sapiens
cctgtgccggaggagtcggagggccctggcagccctcccccctacaagatgatccagaccattgggttgtcggtgggtgccgctgtggcctacatcattgccgtgctgggcctcatgtt

SEQ ID NO: 394 - DNA, 64 bp, Homo sapiens
ctactgcaagaagcgctgcaaagccaagcggctgcagaagcagcccgagggcgaggagccagag

SEQ ID NO: 395 - DNA, 16 bp, Homo sapiens
atggaatgcctcaacg

SEQ ID NO: 396 - DNA, 75 bp, Homo sapiens
gtgggcctttgcagaacgggcagccctcagcagagatccaagaagaagtggccttgaccagcttgggctccggcc

SEQ ID NO: 397 - DNA, 30 bp, Homo sapiens
ccgcggccaccaacaaacgccacagcacaa

SEQ ID NO: 398 - DNA, 36 bp, Homo sapiens
gtgataagatgcacttcccacggtctagcctgcagc

SEQ ID NO: 399 - DNA, 5 bp, Homo sapiens
ccatc

SEQ ID NO: 400 - DNA, 10 bp, Homo sapiens
accacgctgg

SEQ ID NO: 401 - DNA, 2 bp, Homo sapiens
ag

SEQ ID NO: 402 - DNA, 20 bp, Homo sapiens
ggaagagtgagtttggggag

SEQ ID NO: 403 - DNA, 81 bp, Homo sapiens
ggagacctcaagcagttcctgaggatttccaagagcaaggatgaaaaattgaagtcacagcccctcagcaccaagcagaag

SEQ ID NO: 404 - DNA, 42 bp, Homo sapiens
tgtttacacatggagagatgccccatggtgggcaggcagatg

SEQ ID NO: 405 - DNA, 15 bp, Homo sapiens
atgaagtactggcag

SEQ ID NO: 406 - DNA, 11 bp, Homo sapiens
gtcttccccac

SEQ ID NO: 407 - DNA, 19 bp, Homo sapiens
ccttctctcctttcctcat

SEQ ID NO: 408 - DNA, 16 bp, Homo sapiens
cctaagtgcctggcag

SEQ ID NO: 409 - protein, 1070 aa, Homo sapiens [sequence omitted]

SEQ ID NO: 410 - protein, 1014 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 411 - protein, 940 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVANGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 412 - protein, 1030 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLDGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 413 - protein, 1070 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 414 - protein, 816 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGRPQAVPEDFQEQG

SEQ ID NO: 415 - protein, 151 aa, Homo sapiens
MGLGGVSREAGLLLLSSPCPDPSVCLSDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGMLP

SEQ ID NO: 416 - protein, 1030 aa, Homo sapiens; identical to SEQ ID NO: 412

SEQ ID NO: 417 - protein, 364 aa, Homo sapiens
EHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 418 - protein, 1014 aa, Homo sapiens; identical to SEQ ID NO: 410

SEQ ID NO: 419 - protein, 1070 aa, Homo sapiens [sequence omitted]

SEQ ID NO: 420 - protein, 816 aa, Homo sapiens; identical to SEQ ID NO: 414

SEQ ID NO: 421 - protein, 940 aa, Homo sapiens; identical to SEQ ID NO: 411

SEQ ID NO: 422 - protein, 459 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVASEHLCPEGQGEVEGNTGLGVMDRGFPGTHLRSSQFWALQAWESVHYWESV

SEQ ID NO: 423 - protein, 733 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVGMGWGGLCCTGSGGPRRLSPCTQPLCTEHGTEAIFVAAVGIRPSHHAAAQS

SEQ ID NO: 424 - protein, 644 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMAPW

SEQ ID NO: 425 - protein, 940 aa, Homo sapiens; identical to SEQ ID NO: 411

SEQ ID NO: 426 - protein, 459 aa, Homo sapiens; identical to SEQ ID NO: 422

SEQ ID NO: 427 - protein, 139 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKCESQGGCAQSPCQTLND

SEQ ID NO: 428 - protein, 231 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIAGEPGVGAEGMR

SEQ ID NO: 429 - protein, 157 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPR

SEQ ID NO: 430 - DNA, 1536 bp, Homo sapiens
gtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtaaaaaaaaaaaaaaaaaaaaaaaaaaaaaaaaaaa

SEQ ID NO: 431 - DNA, 19 bp, Homo sapiens
tgagagtgattcgcgtggg

SEQ ID NO: 432 - DNA, 21 bp, Homo sapiens
ccagggtacgaggctttcaat

SEQ ID NO: 433 - DNA, 91 bp, Homo sapiens
tgagagtgattcgcgtgggtacccgcaagagccagcttgctcgcatacagacggacagtgtggtggcaacattgaaagcctcgtaccctgg

SEQ ID NO: 434 - DNA, 1331 bp, Homo sapiens
tcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaattt

SEQ ID NO: 435 - DNA, 21 bp, Homo sapiens
tgacactggcaaaacaatgca

SEQ ID NO: 436 - DNA, 21 bp, Homo sapiens
ggtccttttcaccagcaagct

SEQ ID NO: 437 - DNA, 94 bp, Homo sapiens
tgacactggcaaaacaatgcagactttgctttccttggtcaggcagtataatccaaagatggtcaaggtcgcaagcttgctggtgaaaaggacc

SEQ ID NO: 438 - DNA, 1261 bp, Homo sapiens
cttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaaaa

SEQ ID NO: 439 - DNA, 20 bp, Homo sapiens
tgcaccaccaactgcttagc

SEQ ID NO: 440 - DNA, 19 bp, Homo sapiens
ccatcacgccacagtttcc

SEQ ID NO: 441 - DNA, 116 bp, Homo sapiens
tgcaccaccaactgcttagcacccctggccaaggtcatccatgacaactttggtatcgtggaaggactcatgaccacagtccatgccatcactgccacccagaagactgtggatgg

SEQ ID NO: 442 - DNA, 2650 bp, Homo sapiens
agggacagcccagaggaggcgtggccacgctgccggcggaagtggagccctccgcgagcgcgcgaggccgccggggcaggcggggaaaccggacagtaggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtaacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatggatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagccaaaaaaaaaaaaaaaaaaaa

SEQ ID NO: 443 - DNA, 20 bp, Homo sapiens
gaggccgtcaccaagaacat

SEQ ID NO: 444 - DNA, 19 bp, Homo sapiens
ggacagccggtcagagctc

SEQ ID NO: 445 - DNA, 111 bp, Homo sapiens
gaggccgtcaccaagaacattcacgagtcctgcatgagccagataggctggaaccgcatcatcgtggagaagcccttcgggagggacctgcagagctctgaccggctgtcc

SEQ ID NO: 446 - DNA, 541 bp, Homo sapiens
cttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaaca

SEQ ID NO: 447 - DNA, 20 bp, Homo sapiens
ctggcaagcagctggaagat

SEQ ID NO: 448 - DNA, 23 bp, Homo sapiens
tttcttagcaccaccacgaagtc

SEQ ID NO: 449 - DNA, 101 bp, Homo sapiens
ctggcaagcagctggaagatggacgtactttgtctgactacaatattcaaaaggagtctactcttcatcttgtgttgagacttcgtggtggtgctaagaaa

SEQ ID NO: 450 - DNA, 748 bp, Homo sapiens
gcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgcaaaaaaaaaaaaaaaa

SEQ ID NO: 451 - DNA, 23 bp, Homo sapiens
tggcaagaagaaggtctggttag

SEQ ID NO: 452 - DNA, 22 bp, Homo sapiens
tgatcagcccatctttgatgag

SEQ ID NO: 453 - DNA, 101 bp, Homo sapiens
tggcaagaagaaggtctggttagaccccaatgagaccaatgaaatcgccaatgccaactcccgtcagcagatccggaagctcatcaaagatgggctgatca

SEQ ID NO: 454 - DNA, 1867 bp, Homo sapiens
ggttcgctgtggcgggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttaaaaaaaaaaaaaaaaaaaaaa

SEQ ID NO: 455 - DNA, 20 bp, Homo sapiens
cggtttgctgcggtaatcat

SEQ ID NO: 456 - DNA, 21 bp, Homo sapiens
tttcttgctgccagtctggac

SEQ ID NO: 457 - DNA, 122 bp, Homo sapiens
cggtttgctgcggtaatcatgaggataagagagccacgaaccacggcactgattttcagttctgggaaaatggtgtgcacaggagccaagagtgaagaacagtccagactggcagcaagaaa

SEQ ID NO: 458 - DNA, 2201 bp, Homo sapiens
cgggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgatcagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaaaaaaaaaaaaaaaaaaaaaaaa

SEQ ID NO: 459 - DNA, 19 bp, Homo sapiens
atttgggtcgcggttcttg

SEQ ID NO: 460 - DNA, 21 bp, Homo sapiens
tgccttgacattctcgatggt

SEQ ID NO: 461 - DNA, 133 bp, Homo sapiens
atttgggtcgcggttcttgtttgtggatcgctgtgatcgtcacttgacaatgcagatcttcgtgaagactctgactggtaagaccatcaccctcgaggttgagcccagtgacaccatcgagaatgtcaaggca

SEQ ID NO: 462 - DNA, 2277 bp, Homo sapiens
gactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcgcagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggacggtctctgcgatatgataccagctattttgtggagtattttgccttggatctcctgatggagaacggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtcgatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacagacctggtggagaccctggagctgcagaacctgatgctgtgtgcgctgcagaccatctacggagcagaggcgcggaaggagtcacggggcgcgcatgccagggaagactacaaggtgcggattgatgagtacgattactccaagcccatccaggggcaacagaagaagccctttgaggagcactggaggaagcacaccctgtcctttgtggacgttggcactgggaaggtcactctggaatatagacccgtaatcgacaaaactttgaacgaggctgactgtgccaccatcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgag

SEQ ID NO: 463 - DNA, 20 bp, Homo sapiens
tgggaacaagagggcatctg

SEQ ID NO: 464 - DNA, 22 bp, Homo sapiens
ccaccactgcatcaaattcatg

SEQ ID NO: 465 - DNA, 86 bp, Homo sapiens
tgggaacaagagggcatctgctaaagtttcagattccatttctgctcagtatccagtagtggatcatgaatttgatgcagtggtgg

SEQ ID NO: 466 - DNA, 19 bp, Homo sapiens
tcgtgcccaggaggagttc

SEQ ID NO: 467 - DNA, 24 bp, Homo sapiens
ctggaggactcctggattctgtaa

SEQ ID NO: 468 - DNA, 185 bp, Homo sapiens
tcgtgcccaggaggagttcgggcaaggcgagtggagcgagtggagcccggaggccatgggcacgccttggacagagatgaggtctcactatgttacccaggctggtttcaaactcctggcctcatgggattctccagcctcagtctcccaaagtgctgggattacagaatccaggagtcctccag

SEQ ID NO: 469 - DNA, 18 bp, Homo sapiens
ccccgaggagctgagctc

SEQ ID NO: 470 - DNA, 18 bp, Homo sapiens
ctggggacacggtgggtg

SEQ ID NO: 471 - DNA, 113 bp, Homo sapiens
ccccgaggagctgagctccgtgccccccagcagcatctggtgagtccccagaactctgcccggcaaggtgggtccgtgtgctggcgctcactgtccacccaccgtgtccccag

SEQ ID NO: 472 - DNA, 50 bp, Homo sapiens
agaataaaggtatggtggcaagtcctccttctgctaggctggctggcaag

SEQ ID NO: 473 - DNA, 22 bp, Homo sapiens
catgacccttccaaaaggtgaa

SEQ ID NO: 474 - DNA, 20 bp, Homo sapiens
catgatcagcagacccgaca

SEQ ID NO: 475 - DNA, 134 bp, Homo sapiens
catgacccttccaaaaggtgaatgcgtctgttccaaggggtttccctttccactcatcggagattcagagggatgagctggcaccagctgggacaggggtgtcccgtgaggctgtgtcgggtctgctgatcatg

SEQ ID NO: 476 - DNA, 20 bp, Homo sapiens
accctggctcccattacaga

SEQ ID NO: 477 - DNA, 20 bp, Homo sapiens
gaccggatggcagaatcatg

SEQ ID NO: 478 - DNA, 154 bp, Homo sapiens
accctggctcccattacagatctctgagggcagatcttgactcctaaatgttgggcccccccaatttcatttattcctctataacaaacagcccagaccttagcagtgaaaatcaacaatgatttttctttgttcatgattctgccatccggtc

SEQ ID NO: 479 - DNA, 20 bp, Homo sapiens
gaacagccgggtacctaggg

SEQ ID NO: 480 - DNA, 21 bp, Homo sapiens
ggcttctttgagggtcctgtg

SEQ ID NO: 481 - DNA, 85 bp, Homo sapiens
gaacagccgggtacctaggggaagagaccagaggtcagcggccaggctgtgattcccaaagccacacaggaccctcaaagaagcc

SEQ ID NO: 482 - DNA, 19 bp, Homo sapiens
ccgggctgtcacctattcc

SEQ ID NO: 483 - DNA, 20 bp, Homo sapiens
gcactgttcttcagggctgc

SEQ ID NO: 484 - DNA, 121 bp, Homo sapiens
ccgggctgtcacctattcccgaagccgttacctcgaatgcatttcctgtggctcatcagacatgagctgtgagaggggccggcaccagagcctgcagtgccgcagccctgaagaacagtgc

SEQ ID NO: 485 - DNA, 19 bp, Homo sapiens
ccgggctgtcacctattcc

SEQ ID NO: 486 - DNA, 20 bp, Homo sapiens
gcactgttcttcagggctgc

SEQ ID NO: 487 - DNA, 121 bp, Homo sapiens; identical to SEQ ID NO: 484

SEQ ID NO: 488 - DNA, 22 bp, Homo sapiens
taaggaacgggagacacagtcc

SEQ ID NO: 489 - DNA, 20 bp, Homo sapiens
tcagaggagcatccatgggt

SEQ ID NO: 490 - DNA, 101 bp, Homo sapiens
taaggaacgggagacacagtcctggagcttgaaaatctgccgcagaatggccgccagtgttacagctgcaaggggaacagcacccatggatgctcctctga

SEQ ID NO: 491 - DNA, 20 bp, Homo sapiens
gtaacggatccagttggcca

SEQ ID NO: 492 - DNA, 20 bp, Homo sapiens
tgatgagccacaggaaatgc

SEQ ID NO: 493 - DNA, 126 bp, Homo sapiens
gtaacggatccagttggccaacaccacaaggttcgtgcaaaaggcgaagtgatcaggaatcagtcaagccgggctgtcacctattcccgaagccgttacctcgaatgcatttcctgtggctcatca

SEQ ID NO: 494 - DNA, 20 bp, Homo sapiens
agtgatggagcaaagtgccg

SEQ ID NO: 495 - DNA, 21 bp, Homo sapiens
cagcagctgatgcaaactgag

SEQ ID NO: 496 - DNA, 132 bp, Homo sapiens
agtgatggagcaaagtgccgggatcatgtaccgcaagtcctgtgcatcatcagcggcctgtctcatcgcctctgccgggtaccagtccttctgctccccagggaaactgaactcagtttgcatcagctgctg

SEQ ID NO: 497 - DNA, 26 bp, Homo sapiens
acactaaaagaacaaacaccttgctc

SEQ ID NO: 498 - DNA, 22 bp, Homo sapiens
tcctcagaaggcacatgaaaga

SEQ ID NO: 499 - DNA, 106 bp, Homo sapiens
acactaaaagaacaaacaccttgctcttcgagatgagacattttgccaagcagttgaccacttagttctcaagaagcaactatctctttcatgtgccttctgagga

SEQ ID NO: 500 - DNA, 16 bp, Homo sapiens
cgctgcctcaatgggc

SEQ ID NO: 501 - DNA, 18 bp, Homo sapiens
aggccacagctcgcagtc

SEQ ID NO: 502 - DNA, 102 bp, Homo sapiens
cgctgcctcaatgggctctgcttgagcaagggcaaccctgagtgtgacgggaaggaggactgtagcgacggctcagatgagaaggactgcgagctgtggcct

SEQ ID NO: 503 - DNA, 16 bp, Homo sapiens
ccgcgcatgatggtga

SEQ ID NO: 504 - DNA, 20 bp, Homo sapiens
ggagccttgtgtacacgcct

SEQ ID NO: 505 - DNA, 132 bp, Homo sapiens
ccgcgcatgatggtgattccgggggacccctgtccagcgtggaggcggatgggcggatcttccaggccggtgtggtgagctggggagacggctgcgctcagaggaacaagccaggcgtgtacacaaggctcc

SEQ ID NO: 506 - DNA, 19 bp, Homo sapiens
atcactgtggccaatggga

SEQ ID NO: 507 - DNA, 17 bp, Homo sapiens
cccgttggaggcaatgc

SEQ ID NO: 508 - DNA, 120 bp, Homo sapiens
atcactgtggccaatgggagcagcctcccagagtgggtgacagacaacgctgggaccctgcattttgcccgggtgactcgagatgacgctggcaactacacttgcattgcctccaacggg

SEQ ID NO: 509 - DNA, 19 bp, Homo sapiens
gcttgccctttcatgtgga

SEQ ID NO: 510 - DNA, 23 bp, Homo sapiens
tcacgatgagacctgacactctg

SEQ ID NO: 511 - DNA, 111 bp, Homo sapiens
gcttgccctttcatgtggagcactgtgattggacccaagttggcaagagtggaagaccaggggacagaacagaaatccccatggtggccagagtgtcaggtctcatcgtga

SEQ ID NO: 512 - DNA, 18 bp, Homo sapiens
gtgcccagtccccctgtc

SEQ ID NO: 513 - DNA, 19 bp, Homo sapiens
cctggcccgtttaactgga

SEQ ID NO: 514 - DNA, 93 bp, Homo sapiens
gtgcccagtccccctgtcagaccctcaatgactgaggcctgggggatccctcccttacctcagcttctcccatttccagttaaacgggccagg

SEQ ID NO: 515 - DNA, 50 bp, Homo sapiens
gagaagatgaacccgctggaacagtatgagcgaaaggtgaatgcgtctgt

SEQ ID NO: 516 - DNA, 50 bp, Homo sapiens
acaaggctccctctgtttcgggactggatcaaagagaacactggggtata

SEQ ID NO: 517 - DNA, 50 bp, Homo sapiens
cccatggtggccagagtgtcaggtctcatcgtgacgctcttgtcctcctc

SEQ ID NO: 518 - protein, 31 aa, Homo sapiens
EMRSHYVTQAGFKLLASWDSPASVSQSAGIT

SEQ ID NO: 519 - protein, 113 aa, Homo sapiens
VQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 520 - protein, 16 aa, Homo sapiens
GFSPQTIPGGIWDPAG

SEQ ID NO: 521 - protein, 113 aa, Homo sapiens; identical to SEQ ID NO: 519

SEQ ID NO: 522 - protein, 69 aa, Homo sapiens
NPGVLQLRTRCPPPCRHLLLIKTMIIFSSEILQMRQASQCKILLQYHCPHSWLLEGAWPSERSSALPLF

SEQ ID NO: 523 - protein, 52 aa, Homo sapiens
VQEDVEAAGSEGRQDKHASAVLFGAAGPGEASTHPSACSSHLPTGVPQQPGV

SEQ ID NO: 524 - protein, 36 aa, Homo sapiens
DRLSPRCPGWSTAVQSQLTATSASWVQAILPPQPPK

SEQ ID NO: 525 - protein, 11 aa, Homo sapiens
MALPTARPLLG

SEQ ID NO: 526 - protein, 4 aa, Homo sapiens
TPAL

SEQ ID NO: 527 - protein, 1 aa, Homo sapiens
E

SEQ ID NO: 528 - protein, 11 aa, Homo sapiens
MALPTARPLLG

SEQ ID NO: 529 - protein, 4 aa, Homo sapiens
TPAL

SEQ ID NO: 530 - protein, 1 aa, Homo sapiens
E

SEQ ID NO: 531 - protein, 239 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLGIVAAWRQRSSRDPSWRQPERTILRPRFRRE

SEQ ID NO: 532 - protein, 28 aa, Homo sapiens
EALSGTPCLLGPGPVLTVLALLLASTLA

SEQ ID NO: 533 - protein, 11 aa, Homo sapiens
MALPTARPLLG

SEQ ID NO: 534 - protein, 4 aa, Homo sapiens
TPAL

SEQ ID NO: 535 - protein, 1 aa, Homo sapiens
E

SEQ ID NO: 536 - protein, 201 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGIVAAWRQRSSRDPSWRQPERTILRPRFRRE

SEQ ID NO: 537 - protein, 28 aa, Homo sapiens
EALSGTPCLLGPGPVLTVLALLLASTLA

SEQ ID NO: 538 - protein, 11 aa, Homo sapiens
MALPTARPLLG

SEQ ID NO: 539 - protein, 4 aa, Homo sapiens
TPAL

SEQ ID NO: 540 - protein, 1 aa, Homo sapiens
E

SEQ ID NO: 541 - protein, 11 aa, Homo sapiens
MALPTARPLLG

SEQ ID NO: 542 - protein, 4 aa, Homo sapiens
TPAL

SEQ ID NO: 543 - protein, 1 aa, Homo sapiens
E

SEQ ID NO: 544 - protein, 131 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQGIVAAWRQRSSRDPSWRQPERTILRPRFRRE

SEQ ID NO: 545 - protein, 28 aa, Homo sapiens
EALSGTPCLLGPGPVLTVLALLLASTLA

SEQ ID NO: 546 - protein, 15 aa, Homo sapiens
TLILVAVFKYGHFSL

SEQ ID NO: 547 - protein, 15 aa, Homo sapiens
TLILVAVFKYGHFSL

SEQ ID NO: 548 - protein, 18 aa, Homo sapiens
AGSRRMIRFRFDSFDKTI

SEQ ID NO: 549 - protein, 16 aa, Homo sapiens
TGFHRISQDGLDLLTS

SEQ ID NO: 550 - protein, 2 aa, Homo sapiens
GE

SEQ ID NO: 551 - protein, 4 aa, Homo sapiens
DLGV

SEQ ID NO: 552 - protein, 15 aa, Homo sapiens
ECLTVNPSLQIPLNP

SEQ ID NO: 553 - protein, 49 aa, Homo sapiens
VRGGTAGYLGEETRGQRPGCDSQSHTGPSKKPSAPSPLPAGTSWDRGVP

SEQ ID NO: 554 - protein, 18 aa, Homo sapiens
ECVCSKGFPFPLIGDSEG

SEQ ID NO: 555 - protein, 17 aa, Homo sapiens
RECLLPWLPLQISEGRS

SEQ ID NO: 556 - protein, 57 aa, Homo sapiens
PQNPNSQPRAAGSLEVIISHPFVRRLEILISPFQFQNSIPKNSQIVPAASPRGTSSP

SEQ ID NO: 557 - protein, 139 aa, Homo sapiens
LTSFQLPNAPLFLRRPRLRLFSCPLDPLSVSWTPSYPLNTASLPLPSLSAQLPDPETWTLTCCVFDPCFLALGFLLPPPSILCSVPWIFTAFPRIVFFFFFFLRQVLALSPRQESSVRSWLIATSTSWVQAILLPQPLE

SEQ ID NO: 558 - protein, 45 aa, Homo sapiens
SKERETQSWSLKICRRMAASVTAARGTAPMDAPLKRLSSLTAEAP

SEQ ID NO: 559 - protein, 90 aa, Homo sapiens
GRPKDDRHLRGCGYLPGCPGSNGFHNNDTFHFLKCCNTTKCNEGPSKERETQSWSLKICRRMAASVTAARGTAPMDAPLKRLSSLTAEAP

SEQ ID NO: 560 - protein, 8 aa, Homo sapiens
SLLLSPGA

SEQ ID NO: 561 - protein, 53 aa, Homo sapiens
GRPKDDRHLRGCGYLPGCPGSNGFHNNDTFHFLKCCNTTKCNEGPSLLLSPGA

SEQ ID NO: 562 - protein, 5 aa, Homo sapiens
DPLLA

SEQ ID NO: 563 - protein, 34 aa, Homo sapiens
YRSGAAPQPGPAHLSLTITLLMTARLWGGTLLWT

SEQ ID NO: 564 - protein, 45 aa, Homo sapiens
GRPKDDRHLRGCGYLPGCPGSNGFHNNDTFHFLKCCNTTKCNEGP

SEQ ID NO: 565 - protein, 46 aa, Homo sapiens
GRPKDDRHLRGCGYLPGCPGSNGFHNNDTFHFLKCCNTTKCNEGPI

SEQ ID NO: 566 - protein, 84 aa, Homo sapiens
EPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 567 - protein, 83 aa, Homo sapiens
PKNQSYMVRGCATASMCQHAHLGDAFSMNHIDVSCCTKSGCNHPDLDVQYRSGAAPQPGPAHLSLTITLLMTARLWGGTLLWT

SEQ ID NO: 568 - protein, 34 aa, Homo sapiens; identical to SEQ ID NO: 563

SEQ ID NO: 569 - protein, 44 aa, Homo sapiens
RPKDDRHLRGCGYLPGCPGSNGFHNNDTFHFLKCCNTTKCNEGP

SEQ ID NO: 570 - protein, 45 aa, Homo sapiens
RPKDDRHLRGCGYLPGCPGSNGFHNNDTFHFLKCCNTTKCNEGPI

SEQ ID NO: 571 - protein, 84 aa, Homo sapiens; identical to SEQ ID NO: 566

SEQ ID NO: 572 - protein, 83 aa, Homo sapiens; identical to SEQ ID NO: 567

SEQ ID NO: 573 - protein, 29 aa, Homo sapiens
RSLWGSWLPCKSTTALRPPCCEEAQATHV

SEQ ID NO: 574 - protein, 30 aa, Homo sapiens
ERSLWGSWLPCKSTTALRPPCCEEAQATHV

SEQ ID NO: 575 - protein, 45 aa, Homo sapiens; identical to SEQ ID NO: 564

SEQ ID NO: 576 - protein, 46 aa, Homo sapiens; identical to SEQ ID NO: 565

SEQ ID NO: 577 - protein, 28 aa, Homo sapiens
GCGHFCHGKVEFRLGAVAEACTLSTLGG

SEQ ID NO: 578 - protein, 28 aa, Homo sapiens
GCGHFCHGKVEFRLGAVAEACTLSTLGG

SEQ ID NO: 579 - protein, 45 aa, Homo sapiens; identical to SEQ ID NO: 564

SEQ ID NO: 580 - protein, 46 aa, Homo sapiens; identical to SEQ ID NO: 565

SEQ ID NO: 581 - protein, 34 aa, Homo sapiens; identical to SEQ ID NO: 563

SEQ ID NO: 582 - protein, 84 aa, Homo sapiens
KPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 583 - protein, 15 aa, Homo sapiens
SKERETQNRKTKAIW

SEQ ID NO: 584 - protein, 60 aa, Homo sapiens
GRPKDDRHLRGCGYLPGCPGSNGFHNNDTFHFLKCCNTTKCNEGPSKERETQNRKTKAIW

SEQ ID NO: 585 - protein, 34 aa, Homo sapiens; identical to SEQ ID NO: 563

SEQ ID NO: 586 - protein, 45 aa, Homo sapiens; identical to SEQ ID NO: 564

SEQ ID NO: 587 - protein, 46 aa, Homo sapiens; identical to SEQ ID NO: 565

SEQ ID NO: 588 - protein, 84 aa, Homo sapiens; identical to SEQ ID NO: 566

SEQ ID NO: 589 - protein, 49 aa, Homo sapiens
PKNQSYMVRGCATASMCQHAHLGDAFSMNHIDVSCCTKSGCNHPDLDVQ

SEQ ID NO: 590 - protein, 468 aa, Homo sapiens; identical to SEQ ID NO: 20

SEQ ID NO: 591 - protein, 650 aa, Homo sapiens; identical to SEQ ID NO: 166

SEQ ID NO: 592 - protein, 628 aa, Homo sapiens; identical to SEQ ID NO: 71

SEQ ID NO: 593 - protein, 335 aa, Homo sapiens; identical to SEQ ID NO: 216

SEQ ID NO: 594 - protein, 855 aa, Homo sapiens [sequence omitted]

SEQ ID NO: 595 - protein, 1070 aa, Homo sapiens [sequence omitted]

SEQ ID NO: 596 - protein, 18 aa, Homo sapiens
TLPSPAPTRALLLVSCAD

SEQ ID NO: 597 - protein, 30 aa, Homo sapiens [sequence omitted]

SEQ ID NO: 598 - protein, 36 aa, Homo sapiens
PHAVDGLPGLARPEPAQRPWGAGAQAQAHHLPPLLQ

SEQ ID NO: 599 - protein, 21 aa, Homo sapiens
VIPGDPCPAWRRMGGSSRPVW

SEQ ID NO: 600 - protein, 46 aa, Homo sapiens
MGSDRARKGGGGPKDFGAGLKYNSRHEKVNGLEEGVEFLPVNNVKK

SEQ ID NO: 601 - protein, 20 aa, Homo sapiens
ELWPSAFKGASPCSMLPPPL

SEQ ID NO: 602 - protein, 49 aa, Homo sapiens
VAPGAGGRQVGPGRGGTGDSRQGLSPPRVIPGDPCPAWRRMGGSSRPVW

SEQ ID NO: 603 - protein, 10 aa, Homo sapiens
GGLQCVYLCK

SEQ ID NO: 604 - protein, 46 aa, Homo sapiens
GRPKDDRHLRGCGYLPGCPGSNGFHNNDTFHFLKCCNTTKCNEGPK

SEQ ID NO: 605 - protein, 110 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGSPCRGLAPGREEQRALHKAGAVGGGVR

SEQ ID NO: 606 - protein, 139 aa, Homo sapiens
SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 607 - protein, 5 aa, Homo sapiens
MWVLG

SEQ ID NO: 608 - protein, 21 aa, Homo sapiens
ENTQRPAAEARLCAANPVLPV

SEQ ID NO: 609 - protein, 21 aa, Homo sapiens
DTKRTNTLLFEMRHFAKQLTT

SEQ ID NO: 610 - protein, 29 aa, Homo sapiens
SHCVTRLECSGTISAHCNLCLPGSNDHPT

SEQ ID NO: 611 - protein, 27 aa, Homo sapiens
DRVSLCHEAGVQWNNFSTLQPLPPRLK

SEQ ID NO: 612 - protein, 18 aa, Homo sapiens
TLPSPAPTRALLLVSCAD

SEQ ID NO: 613 - protein, 30 aa, Homo sapiens [sequence omitted]

SEQ ID NO: 614 - protein, 36 aa, Homo sapiens; identical to SEQ ID NO: 598

SEQ ID NO: 615 - protein, 21 aa, Homo sapiens
VIPGDPCPAWRRMGGSSRPVW

SEQ ID NO: 616 - protein, 20 aa, Homo sapiens
ELWPSAFKGASPCSMLPPPL

SEQ ID NO: 617 - protein, 49 aa, Homo sapiens; identical to SEQ ID NO: 602

SEQ ID NO: 618 - protein, 51 aa, Homo sapiens
GMGWGGLCCTGSGGPRRLSPCTQPLCTEHGTEAIFVAAVGIRPSHHAAAQS

SEQ ID NO: 619 - protein, 40 aa, Homo sapiens
EKLKFTPPPQPQQCMEFDKEATVPCSATGREKPTIKWERA

SEQ ID NO: 620 - protein, 107 aa, Homo sapiens
GKDRILDPTKLGPRMHIFQNGSLVIHDVAPEDSGRYTCIAGNSCNIKHTEAPLYVVGMGWGGLCCTGSGGPRRLSPCTQPLCTEHGTEAIFVAAVGIRPSHHAAAQS

SEQ ID NO: 621 - protein, 131 aa, Homo sapiens
TVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERAD

SEQ ID NO: 622 - protein, 324 aa, Homo sapiens
TVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVGMGWGGLCCTGSGGPRRLSPCTQPLCTEHGTEAIFVAAVGIRPSHHAAAQS

SEQ ID NO: 623 - protein, 3 aa, Homo sapiens
APW

SEQ ID NO: 624 - protein, 18 aa, Homo sapiens
GKDRILDPTKLGPRMAPW

SEQ ID NO: 625 - protein, 40 aa, Homo sapiens; identical to SEQ ID NO: 619

SEQ ID NO: 626 - protein, 131 aa, Homo sapiens; identical to SEQ ID NO: 621

SEQ ID NO: 627 - protein, 235 aa, Homo sapiens
TVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMAPW

SEQ ID NO: 628 - protein, 56 aa, Homo sapiens
GKDRILDPTKLGPRMHIFQNGSLVIHDVAPEDSGRYTCIAGNSCNIKHTEAPLYVV

SEQ ID NO: 629 - protein, 267 aa, Homo sapiens
KSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 630 - protein, 50 aa, Homo sapiens
SEHLCPEGQGEVEGNTGLGVMDRGFPGTHLRSSQFWALQAWESVHYWESV

SEQ ID NO: 631 - DNA, 5103 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgaggggccctggacggggaggtggtgcccgtgtgcgggagctgagcgccctcccgcggccacggaggggagagcgccagcactctggaaaccgagcggctgttgctgggtcctggagctgggactgccccacccctagcgggaagcctggagttggattcccagggcctcgtcttctgagcaacctggcttgagacttcttcattggagccccttggaccagcttcctatgattccctgctgtttcctcctcccagcacaaaaccacagatatcattagtatatgtacacacgttgctgttgcatgtcttgtctccctctatgagtctaagagctcccccaggggcagtctttctgtttacttcccttctcctatccccacttcctggactgggagctccttgaggtcattgctgggtctctcctatcagctcaggtgttcaggagcagaggttgggtctccattattgtgattttccctttgtgcctgtttagggctttgcccaataggaggccccatgaaagcaaaaatccttatgtgtagctatggtattaaggaccagtgattcagattagatgtctgcagttggcttcatctcagaggtcataatcagctgcatcactaaggggtcataccctaggggatagccatacatcccccacccagccccagccccattatttcatcatttgggcttgccctttcatgtggagcactgtgattggacccaagttggcaagagtggaagaccaggggacagaacagaaatccccatggtggccagagtgtcaggtctcatcgtgacgctcttgtcctcctccttcccaggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgt

SEQ ID NO: 632 - DNA, 4870 bp, Homo sapiens
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgaggggccctggacggggaggtggtgcccgtgtgcgggagctgagcgccctcccgcggccacggaggggagagcgccagcactctggaaaccgagcggctgttgctgggtcctggagctgggactgccccacccctagcgggaagcctggagttggattcccagggcctcgtcttctgagcaacctggcttgagacttcttcattggagccccttggaccagcttcctatgattccctgctgtttcctcctcccagcacaaaaccacagatatcattagtatatgtacacacgttgctgttgcatgtcttgtctccctctatgagtctaagagctcccccaggggcagtctttctgtttacttcccttctcctatccccacttcctggactgggagctccttgaggtcattgctgggtctctcctatcagctcaggtgttcaggagcagaggttgggtctccattattgtgattttccctttgtgcctgtttagggctttgcccaataggaggccccatgaaagcaaaaatccttatgtgtagctatggtattaaggaccagtgattcagattagatgtctgcagttggcttcatctcagaggtcataatcagctgcatcactaaggggtcataccctaggggatagccatacatcccccacccagccccagccccattatttcatcatttgggcttgccctttcatgtggagcactgtgattggacccaagttggcaagagtggaagaccaggggacagaacagaaatccccatggtggccagagtgtcaggtctcatcgtgacgctcttgtcctcctccttcccaggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctgt

SEQ ID NO: 633 - protein, 796 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGEGPWTGRWCPCAGAERPPAATEGRAPALWKPSGCCWVLELGLPHP

SEQ ID NO: 634 - protein, 45 aa, Homo sapiens
EGPWTGRWCPCAGAERPPAATEGRAPALWKPSGCCWVLELGLPHP

SEQ ID NO: 635 - protein, 40 aa, Homo sapiens; identical to SEQ ID NO: 619

SEQ ID NO: 636 - protein, 56 aa, Homo sapiens; identical to SEQ ID NO: 628

SEQ ID NO: 637 - protein, 131 aa, Homo sapiens; identical to SEQ ID NO: 621

SEQ ID NO: 638 - protein, 387 aa, Homo sapiens
TVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGEGPWTGRWCPCAGAERPPAATEGRAPALWKPSGCCWVLELGLPHP

SEQ ID NO: 639 - protein, 682 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVV

SEQ ID NO: 640 - protein, 335 aa, Homo sapiens
KNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGEGPWTGRWCPCAGAERPPAATEGRAPALWKPSGCCWVLELGLPHP

SEQ ID NO: 641 - protein, 116 aa, Homo sapiens
KESHLSPFTDQLCWEDAEINDQRPGVRELPPEVAGGEKGEEELKLRRRFPRKWMLPKDVRKGDGNVRIGGGGTNALRRASGLPHHLLQGSGRKAKIAPGHPRESARLCAANPVLPV

SEQ ID NO: 642 - protein, 132 aa, Homo sapiens
EPDCVCLAGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 643 - protein, 8 aa, Homo sapiens
EPDCVCLA

SEQ ID NO: 644 - protein, 6 aa, Homo sapiens
LFSAHC

What is claimed is:

1. An isolated polynucleotide consisting of SEQ ID NO:287.

2. An isolated polynucleotide consisting of SEQ ID NO:505.

* * * * *

UNITED STATES PATENT AND TRADEMARK OFFICE
CERTIFICATE OF CORRECTION

PATENT NO. : 7,488,813 B2
APPLICATION NO. : 11/362260
DATED : February 10, 2009
INVENTOR(S) : Pollock et al.

It is certified that error appears in the above-identified patent and that said Letters Patent is hereby corrected as shown below:

Column 127:
Lines 33-34, delete "http://www"
Line 38, delete "http://www"
Line 42, delete "http://www"

Column 129:
Line 12, change "Set at.affymetrix.com/products/arrays/specific/" to
 -- Set at .affymetrix.com/products/arrays/specific/ --
Line 14, change "at.affymetrix.com/products/arrays/specific/hgu133.affix).;" to
 -- at .affymetrix.com/products/arrays/specific/hgu133av2.affx; --
Line 16, before "/hgu133plus.affx)." insert -- .affymetrix.com/products/arrays/specific --

Column 184:
Line 31, change "Occuffence" to -- Occurrence --
Lines 42-43, change "level.ambion.com/techlib/tn/91/912.html)" to
 -- level (.ambion.com/techlib/tn/91/912.html). --
Line 47, change "NCBJ server.ncbi.nlm.nihi.gov/BLAST/)." to
 -- NCBI server (.ncbi.nlm.nih.gov/BLAST/). --

Column 185:
Lines 27-28, change "Ther.asgt.org)." to -- Ther .asgt.org). --

Column 219:
Line 22, change "USA.biochain.com)," to -- USA .biochain.com), --
Line 23, change "USA,.absbioreagents.com)" to -- USA, .absbioreagents.com) --
Line 24, change "USA,.ambio.com)." to -- USA, .ambio.com). --

Column 232:
Line 28, change "/LocusLinkl>." to -- /LocusLink/>. --

Column 267:
Line 20, delete "http://www"
Line 21, delete "http://www"

UNITED STATES PATENT AND TRADEMARK OFFICE
CERTIFICATE OF CORRECTION

PATENT NO.      : 7,488,813 B2
APPLICATION NO. : 11/362260
DATED           : February 10, 2009
INVENTOR(S)     : Pollock et al.

It is certified that error appears in the above-identified patent and that said Letters Patent is hereby corrected as shown below:

Column 337:
Line 33, change "/LocusLinkl>." to -- /LocusLink/>. --

Column 393:
Line 39, after "knowledgebase," insert -- available from <.expasy.ch/sprot/>; or
   Locuslink, --
Line 40, change "from.ncbi.nlm.nih.gov/projects/Locuslink/>." to
   -- from <.ncbi.nlm.nih.gov/projects/LocusLink/>. --

Column 531:
Line 64, after "knowledgebase," insert -- available from <.expasy.ch/sprot/>; or
   Locuslink, --
Line 65, change "from.ncbi.nlm.nih.gov/projects/LocusLink/>." to
   -- from <.ncbi.nlm.nih.gov/projects/LocusLink/>. --

Column 602:
Line 13, change "from.expasy.ch/sprot/>;" to -- from <.expasy.ch/sprot/>; --
Line 14, change "from.ncbi.nlm.nih.gov/projects/LocusLink/>." to
   -- from <.ncbi.nlm.nih.gov/projects/LocusLink/>. --

Signed and Sealed this

Thirty-first Day of March, 2009

JOHN DOLL
*Acting Director of the United States Patent and Trademark Office*